United States Patent 7,745,391 (HUMAN THROMBOSPONDIN POLYPEPTIDE) - sequence listing, part 5

SEQ ID NO: 10924 - DNA, 4019 bp, Homo sapiens
ccgactggaaagggatgggagtgataccatagggtttggggggcttggcacaacggccctggcctctgcactgtgatagctccaagccaaatggtgcaaggcagctgctgggctgcggggaagaggggctgcacttcctgagctggtgcagcggcagagtggataaggatcaggaccccgagccctcctggccctccaaggcggggggacaccggctgcacccaggctgtgacctcagctgacgccgatgatccacatgggatgcagggtctaattttagctccagccacaggggccacagcccagaagcgtctgccagcgggcacaggggcagccagggctgctcaggcaaggggaggagtgggaagaccagcccagctccctccagcctgtccctggccaagccgcctcctgtgggagctctgactggtccccatggcctggcagacagccctcctctcagttgagggcaaggtcaaggggtgcagccaggagggcagggggacacggccctgcattctggacaggggttgcgtcagccagagcagtgcccaggggcaggggtccctgctgggagggaaaaggctggcttggttgtccaaaggccgagaaggcagagtcctgagagcaggggggccaggccagcaagctgggtcccacctggcctcctcctgcctggctggtgactcactatctgaccttagacaggcggcctggtctcgatgggcctcagtcttcccatctgtacaatgacagcacaggactagcaggtcggtcccagctctggtctcccgccccaggccctgctcttcctgcttgctggcagaggcctcccagcttccctagccctgactgtgggtggccacatgcagtcgtggaggagaagaaagtccctgtggctggcactgtcagcctcctggctcctgcttgtcctgctgggaggcttctcccttctccgcctggcgttgcctcccagacctcggcccggggcttcccaaggctggccccgctggctggatgcagagctcctgcagagcttctcccagcctggagagctcccagaagatgccgtttcacctcctcaagcccctcatggtggcagctgcaactgggaatcttgctttgatacctcaaagtgcaggggcgatggccttaaggtattcgtgtacccagcggttggaaccatctctgagactcatcgcaggatcctggcttccattgagggctctcgcttctacacattcagccctgctggggcctgcctcctcctcctcctcagcctggacgcccagactggagagtgcagctcaatgcctctgcaatggaacaggggcaggaaccatctggtcctccgtctccacccggctccctgccccaggaccttccagctgggacaggctatggtggctgaggccagccccacggtggactccttccggcccggctttgatgtggccctcccttttctccctgaagcccacccgttgcgaggtggggctcctggccagctgcggcaacacagcccccagcccggggtagccctgctagccctggaagaggagaggggtgggtggcgcacagcagacactggctcctctgcctgcccctgggatgggcgctgtgagcaagaccctggacctgggcagacccagcgccaggagacgctgcccaatgccaccttctgcctcatctctggccaccgtcccgaggctgcctcgcgcttcctccaagccctgcaggccggctgcatcccagtgcttctcagcccccgctgggagctgcccttctccgaggtcatcgactggaccaaggcagccatcgtagctgatgagaggctcccacttcaggtcctggctgccctccaggagatgtcccctgcacgggtcctcgccctgcgtcagcagacccagtttctatgggatgcctacttctcctcagtggagaaggtcatccataccactctggaggttattcaggaccggatttttggaacatcagctaacccctcactgctgtggaacagccccccaggggcactcctggccctgtctactttttccacaagcccccaggacttccccttctactacctgcaacagggctcccgccctgagggcagattcagcgccctgatctgggtggggcccccaggccagccccctctgaagctcatccaggcggtggcaggctcccagcactgtgcccagatcttggttctctggagcaatgagaggccactcccatccaggtggccggagacagctgtgcccttgacagtcattgatgggcacaggaaggttagtgatcgcttctacccatatagcaccatcagaacagatgccatcctcagcctcgatgcccgcagcagtctttccacaagtgaggtggactttgcctttctggtgtggcagagcttcccagagcggatggtgggcttcctgacgtcgagccatttctgggacgaggcccatggtggctggggctacactgctgagaggaccaacgaattctccatggttctcaccacagccgccttctaccataggtattaccacactctcttcacccactccctgcccaaggctctgaggaccctggcagatgaggcacccacctgtgtggacgtcctgatgaatttcatagtagcagcagtcaccaagctgccccctatcaaggtgccctatggcaagcagcgccaggaggctgctccactggcgcctgggggcccggggcccaggccaaagccgcctgccccagcccccgactgcatcaaccagatagcggcagcgttcggccacatgcccttgctgtcctctcgtctgcgtctggacccggtgctgtttaaggacccggtgtccgtgcagcgcaagaagtaccgcagcctggagaagccctaggggggcgacccgcggagaccccagcagaggtcgcagcccagctcccagggggcccggcgcctgccggcgggctccgctcttgggacaccggagaacctatcatgtcagccagcgggcccacacgtcggaccccggttggccaatcacaacaggggggcgtggccttaccttctcctgctcgccctcagccgcggagcctctgcggaggctgagccccgcgaccggagcgccgctctccgcttctccacccagctaacttctgctcgtctttcagagcattgtctcctccagggacttgcctggccctcctccccctccgcccccaatgggttcggtctcctttgcgctttcgcagcccagtgtttgccgcggttcccgcacggtcaggccccaggactggcttgcgagccccggggggcgggtcgtgtcgtgtccttttctctctggctaggcaggtgtgccgcaaatatttgacgaatagatggatggcagacattaactgcgtgcctggccctatgagggcggcggcgggacagggtgagcggagagacagaactgtccccgccccaccccgccacccattcctagggttcctagtcccgggaaggcaactacccaaagacgcctgggttgtcaggctcaatccttgagcctcaaccaaggagcagaggggtgcgggtaaacgaggagtggggcgaggaaagcgggatgggaacaagtggcctgtccccgcacggcccgcggctcagcctcggccgtctgccctgcactaccaaggccgaccactagaggtcagcgtcgcgccgcactcttcacccgcatgtccagagggcggccgggatgtggagggtgaacgctgtgggcagctcgggggctgaaagctgggaagagaaatctgaagaacagccccatctctttcgcctgcacacttggaactcagcaagaagggactgtttctaggtgggctgggcgcgagcagggactgtcccgagcggtataggtgagaatggagttggggggggacactaggtctccggggttcacccacctggagctggaattatcacttccgaaataaagcgcgtgtccttgccccctcacgctccaggctataaaaaaaaa

SEQ ID NO: 10925 - DNA, 397 bp, Homo sapiens
ttttttttctgagacggagtctcgtctgtcacccaggcgggagtgcggtggcgcgatctgggctcgctgcaagctccgcctccagggttcacgccattctcctgcctcagcctcccaagtagctgggactacaggcacccaacaccacgcctggctaattttttgtatttttagtagagacggggtttcaccgtgttagccaggatggtctcgatctcctgacctcatgatcctcccacctcagcctcccaaagtgctgggattacaagcgtgagcaccacgcccggccaaccaaacaactcttaattaaatcagaaatgcctttgcaattatacactacccacccctaaagaagaaggtttttacaagtgtagacgactcctccttcatatcgccc

SEQ ID NO: 10926 - DNA, 664 bp, Homo sapiens
acagtatctggccagttccctattacaaccttagtacctggcattaattaaaataaaaacactttttacctgggcaagtggctacttggaataaagacagcatttttcaacattccctgaagctaggtacagccatgtgactaagttctggccacgcaagataaccagaggtggaggaacaacttctaaaatatgtctttaaagtgaatgtgagtattctttaaccattatttcttcctgttgggtgaaaatcagactggatggcaggagctcaagcagtcatcttgaactatgaggtagaagccttgtccataaggatgacacagcaaaaagatgaagtgtgtgggtctcgcctatgaacatcccgcctctgcattgacttactgtggacacctattaccagtgagagaaaaacttcatcgctattattttaggttctcagtatctcaagtgaaataatgaattaaaaatgataaacccatctctgttaggttttccctataaaactttcattgtctacataatcttatacttcagagagagtgcttgggctatattttagtgttataaaaatcatgttacaatgatagggcctagcactagcatggaacgtggtagatcacttttttaaataaatgaatattttctgttctttataattaaa

SEQ ID NO: 10927 - DNA, 510 bp, Homo sapiens
acaaaaacaaaaacaaaaaaaacaaaaaacaaaaaacagatgtgttggcatgcacctgtagtcccagctacttgggaagctgagacaggagaattgcttgaacccgggcggcgcaggttgcagtgagctgagatggtgccaatgcactccagcctcggcaacagagcaagattccatctcaaattaaaaaaaaaagttcgtaataaactacaaatattggaatattaatttatggtctactataaaaactggcttttatctttaataacaccaacaaaaagaattactttttatttacttctgacgatttcctattgtggcaaagattactaattgctccttattatgtattatactccttttcctcagtaaaataaaaacactttttacctgggcaagtggctacttggaataaagacagcatttttcaacattccctgaagctaggtacagccatgtgactaagttctggccacgcaagataaccagaggtggaggaacaacttctaa

SEQ ID NO: 10928 - DNA, 279 bp, Homo sapiens
taaaataaaaacactttttacctgggcaagtggctacttggaataaagacagcatttttcaacattccctgaagctaggtacagccatgtgactaagttctggccacgcaagataaccagaggtggaggaacaacttctaaaatatgtctttaaagtgaatgtgagtattctttaaccattatttcttcctgttgggtgaaaatcagactggatggcaggagctcaagcagtcatcttgaactatgaggtagaagccttgtccataaggatgacacagc

SEQ ID NO: 10929 - DNA, 478 bp, Homo sapiens
ggcagagcaatcatttacctatattctttggggtgtatgccaaggtaaggtctctaggtagcccagttgctttgtctaaaacagaagactcttaaaagaagctcctgtattctccctgagctgacctttcctgtcttgtccctcgatattaagcttatgctatcgagcctcatctcagttagatatctgtggcttcctttgccagctgacctagctggagctgctaatggagtaatcaagtatgaattcctgtataaatcaagtctggctcttattccagggatctagactactacaggcctacacaatttagaaaccctcattagatagatgcaagtagttgtaaatataaacctagctaggggccttctgacttaatgtgtctcccaggaagccctccaggtttggaagccttctcagttcacagggaaagaaaattcatttcctccttcttgccttcctttgccatttcaagatg

SEQ ID NO: 10930 - DNA, 336 bp, Homo sapiens
gtagtcccagctacttgggaggctgaggcaggagaactgcttgaacctgggaggcagacattgcagtgagccaagatggcaccactgcactccagcctggtgacagagtgagactgtctaaaaaaaaacaaaaacaaaaacaaaaaacaaaaggaataccatctcacgggcagagctgcccaggggtgaccatggctgatcacaagctcccacctatttaagcacctactgtgtgccagacacattgccctgataatgccgttgttaacaatcccatgaggtaggtactaatatcacccctgttttgcagattaggaaactgaagcttagagaggt

SEQ ID NO: 10931 - DNA, 1210 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtactgagtgatgaggaacagccatttggggtccctaggagggattaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10932 - DNA, 1022 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10933 - DNA, 1283 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttgggtgagggacgggaaggggagaatttcgtaaggtgctctccttttccacatccctaacagcagctcccgaatccctgcatctcccgccccaggctgaaccttccctctccttcctctcgcagattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10934 - DNA, 1236 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttggattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10935 - DNA, 1405 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttgggtgagggacgggaaggggagaatttcgtaaggtgctctccttttccacatccctaacagcagctcccgaatccctgcatctcccgccccaggctgaaccttccctctccttcctctcgcagattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtactgagtgatgaggaacagccatttggggtccctaggagggattaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10936 - DNA, 1839 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttgggtgagggacgggaaggggagaatttcgtaaggtgctctccttttccacatccctaacagcagctcccgaatccctgcatctcccgccccaggctgaaccttccctctccttcctctcgcagattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtactgagtgatgaggaacagccatttggggtccctaggagggattaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagattttacccacagtgtggggagtttctatttttctagcctgtgaaatggggttggttgtcctgaggtgcagagaccagaatgtgagacattagactgcatcaggtttgccatctaaacttagggcaaccccaagtgcttgaacctataccaccccactttcctgagctctgtaaagagcatgaagttttcccactgaccccatacactgaggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacat

SEQ ID NO: 10937 - DNA, 1791 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttgggtgagggacgggaaggggagaatttcgtaaggtgctctccttttccacatccctaacagcagctcccgaatccctgcatctcccgccccaggctgaaccttccctctccttcctctcgcagattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagattttacccacagtgtggggagtttctatttttctagcctgtgaaatggggttggttgtcctgaggtgcagagaccagaatgtgagacattagactgcatcaggtttgccatctaaacttagggcaaccccaagtgcttgaacctataccaccccactttcctgagctctgtaaagagcatgaagttttcccactgaccccatacactgaggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacat

SEQ ID NO: 10938 - DNA, 1217 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttgggtgagggacgggaaggggagaatttcgtaaggtgctctccttttccacatccctaacagcagctcccgaatccctgcatctcccgccccaggctgaaccttccctctccttcctctcgcagattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10939 - DNA, 1197 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttgggtgagggacgggaaggggagaatttcgtaaggtgctctccttttccacatccctaacagcagctcccgaatccctgcatctcccgccccaggctgaaccttccctctccttcctctcgcagattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10940 - DNA, 1162 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10941 - DNA, 614 bp, Homo sapiens
gggcggggccaagacgtccgactgtctcgtacagttccatcactgctcttatggaacggagggtctacgtgcgtgtcgacccagaaaggccagagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10942 - DNA, 1357 bp, Homo sapiens
agtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttgggtgagggacgggaaggggagaatttcgtaaggtgctctccttttccacatccctaacagcagctcccgaatccctgcatctcccgccccaggctgaaccttccctctccttcctctcgcagattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 10943 - DNA, 411 bp, Homo sapiens
gccagtttttaggcaggtcaagactcacattacaggttcagagaaaccgtgagtgacaggcagccttgattacaatcaaagagcagctgcccaagattccagcaaccattaagaaagggagatgctacaatttaggccctagagagcaacatctaaggttaaggttgacatactaagtctctttctagcaccattaggcaccttgggggcaaggaaagtgcacagaatcaaagccaggcagatgtgggtttcaattctaaccagctgctggcctggggagaggggccctgctcactctgtgcctcagtttcctcattttcgaaataagaattttactacctgctggatacatacgaacttcatggtaaggatgaaaaatgtgtataaagatgaacagaatatagagctcag

SEQ ID NO: 10944 - DNA, 324 bp, Homo sapiens
gaagcctctgctactgtctggaattgactttgagtaagttactttcacagattagttcctcagttgctcatctaaaaaaaccaggaaaataattttctgcaaagttgttatccagtattatgtgagatcatgcatatcaacgtgcttcataaatggtaaatctctaaatacaaatactagttattaacccaggctaaactgcacttgctttccctggcagccaacgaacactttggcttggattgactttttagtgaaataaaaccttcactttttcaagtgaactctattaaaccatccccctaagctatatgctaatcagaa

SEQ ID NO: 10945 - DNA, 683 bp, Homo sapiens
tgtcatgcagtaaaatgtacgcctttttgataacatgcagaactgtgttatcacctcagcaatcaagatacagaacagttccgtcacccctcaaaactccctcatgctacccttttaaaatcaaatcctccccagccctgacctcagggaacggctgattttttctctacccctaaaatattggcatataaatggaatcatacttttataaaacctttagagactgaccgctttcacccagcataacaccctggagatgcatccgagttgagtgtccccagcgggcctctgcttttgtccctgggcagtattccatcatatgaacataccactgcttcagatccatcctgcagttgaggggcatttgggttgttttcagcttttggcagttatgaaaactgctattgtcattcatgtacagttttttgtatgaacataggttttcattttactagagtaaatacctaggagtgtgatttcagggtcatatggtgatatggtttggctgtgtccacacccaaatctcaccttgaattgtagtaatccccaagggtcaggggtggggccaggcggagataattgaatcgtgggggtggtttcccccatactgttcttgtggtggtgaataagtctcttgagatctgatgattttataaaagggagttcccccgcacaaagtccct

SEQ ID NO: 10946 - DNA, 426 bp, Homo sapiens
gtgacagagtgatactccgtcttaaaaaaaaaaaagaaaaagtgccacgcattaaaaattaaccataaggagttgtgttgtgggatctggaagagggaaaagtagactcagagagagggttcaggtgaggtccagtattggcattctctatttcagggtcagtcatgtcttgccttttgtaatgaagccataatccctaaggaaattctagacaaggcagatttgaagactttttgcctccataatgcatttcatgtttcatttcaaatttctgctttgtcctttccattaagagacttagacttatcagaaaaaacaaacgttttagttctcatatctcagaagatagaaatttgttgacattgaagcagaagggggataactgagacataagaaagcatggtataaaagggaccacgatggtgt

SEQ ID NO: 10947 - DNA, 802 bp, Homo sapiens
aggtaaacccttatgagacaggaaacagcaaaggctagctttaggagagaaagtacagcacctggtgtttttatttatgagaaccttttctttgtccactttctctgtaatgaccttctatccctccgtttttgcctgcctgccattctcctattaggttggtggtttttattttcctctaagttccttccaccaaataaatattacgtaaaaaattcataccaaatcaatgagaatactggcaaggaatacatagggactttctgctatatatgtaactttttattacttaaaggtaccgaaggaaggccaggtgcagtggctcacgcccagcactttgggaggctgaggtgggaggatcccttggggccgggagttcaaggttacagtgagctatgatagtgccactgcactccagcctgggtgacagattttgtcttaaaaaaaaaaaaaaaagttgatatgagttttattttctgtccgtttgaaatattttgtaatattccctgcattctctgtcgtctgcctcttccacataatgtcctttgctttcatgtttgttatcttctttttctgttcactcagaggtcatcaatttctttctctccgtccttaattggattatttttcttttggcctttgggcacagagtctgacctctggaccactctaactggagaaggaactttatgttccctctcctgctgtgtccacaaccttagaaatctgtagctagatttttgttgttatagatagaatttactgtttctgaaacccaaatacagttatcagtttaaggtta

SEQ ID NO: 10948 - DNA, 481 bp, Homo sapiens
gcagccgcctactactactaaattcgcggccgctcgactctgaaacatgtgtttatttaactttaggagccttaagcatgttgaggaatgttatggagaataagtataaaaatcatagtatagctctaataagcacaaatgaagtatacatctgtttgatcaaaaacattttcttatttttcttccttaatcacttgttgaatgctaactatatgccaggtattgtgtctggtcttgagggcggttgggatacaaagaaagtaagacagttttataccctgtaaggagcttacagtctagtgaaagagttacaccaagccatgtgtgctggcttgcacctgtaatcctagctacttgggaggatcgcttgagcctaggagtttgaggctgcagtaagctatgatcatgagactgcaccacagccttgacaacagaatgagaccctgtctcaaaaaaaaaaaaaaaaaaaaaaaagacaagg

SEQ ID NO: 10949 - DNA, 517 bp, Homo sapiens
ttagttaggcaacatagaacaaaatagaggtcacaggttccatgcactgaagaatggaattgaaatagagactccagggtcatagactcttggaaggaagactagagtacattcatgaccctcacccttaattacttcacaggtgagaaaaccaagagctacagaaaataagttattcctcagtaccagggcctggttccttggagaattgggttaaaattcaaaataaccttctaaaaaattctttcagaaacgagtagtgaaagccagtggatcaaattcagtgatagttaacagagaaacagcagcatagataagtaagccaatttaatgtagggagcaaccactagtgtacatgatctcagctcatctggtactaccaagtaaaaatgaacctgggccagccacagtgactcatgcctgtactctcagcgctttgggaggccaaggtgggaggattgtttgaggccaggaatttgagaccatcctggtcaacatagcaagaccctgtttgttt

SEQ ID NO: 10950 - DNA, 286 bp, Homo sapiens
atttgctttaaagaccacttcataataagaaaggcagcagaacattcagtagggttaaatgaagtccttttacatacacttttgtttttatcttcagctagatttttaattaagtactggttatgatgtatatattttggtgctagttttatttggggttgctttttttgtttgttcacaataacctagtcatatgatagttacacattgtggttatgattgcctgtgaacaaaccgtacatttggagggactatttgcaatattaataatgtctcataaatctgt

SEQ ID NO: 10951 - DNA, 472 bp, Homo sapiens
  misc_feature (426)..(426): n is a, c, g, or t
gaaaaacagccatttattataaaatatttattctaaattttaagttcaggttagtaaagacaattttaaatttttgagcgccattaaaatgaatgacacattatttttactctttaatcgatagtggcatcaactatgcatatacaatatctacaaaaatgatttaagcatttactttagaaagagagtttagacaatcctgtgtttcttatcaatatcgactttattaagaaaaatatccactgtgcccagccatagttgaatttcatggtcagtggaacacacagcaggtcctccactgtgccagcttctttcacttactgtttttgacactcacatgtaccgtcgtgggcgccggtgtggtctttgttgctgagtgccgtcccgtcatatggacgtgcgtcgtggggcgccggtgtgtcttgnttgctgagtgccgtcccgtcatatggacacctcatgatttgttggg

SEQ ID NO: 10952 - DNA, 799 bp, Homo sapiens
ctgtctagactcttaatgctgtgacccttgaaaacctagagaatttaatgtctccagttgggctgaatttaggtttaggtttggtagaataatgggaagggtaagtcttcagagacacttgacggagtcctcagagacacttgacaaacttgggaaaggaaagaagagtaggaacaactgggcatgctcagtgataccctgagcaaccacattacttcgctagatcctgccctttttctcaacaaaaagtagttcaagaattatttcctgagttgatcaaaaagacttattgtcatatggttaattatgtgttgagcatgtctttttattatttttgtaacagacaaaaaaaattaccatataatttaagaaaagaaggtactttccatatctcctgagttggagatacttctgaaaggagcagaagagatgggagaaatgtacaattctactttattcctgaagtcctggttttaccagataaaatgaagtgagatgaaaattaaactttcttgtctgattttttttttctaccaagttatagactttaaattttggcaggataaaaataaaatgtgagacagatttactttttggctcacataacttcaaataaggcgacttaaaaatggtttggagcattagtattttgactgtagaaaaaatttattcatttaatattaactgtttatgtgtctagcgttttccttgggtctgttggtctctgctttctggtaccttatttgtctagtaccttatttgtggaaacaaaaccaatctatacacaatggtcacagaa

SEQ ID NO: 10953 - DNA, 1143 bp, Homo sapiens
ctgtctagactcttaatgctgtgacccttgaaaacctagagaatttaatgtctccagttgggctgaatttaggtttaggtttggtagaataatgggaagggtaagtcttcagagacacttgacggagtcctcagagacacttgacaaacttgggaaaggaaagaagaagatgggagaaatgtacaattctactttattcctgaagtcctggttttaccagataaaatgaagtgagatgaaaattaaaaaaaaaaaaaaaaaaaaaaaaaaaaaaaaaaaaaaaaaaaaaaaaaaaaaaaaaaaaaaaaaaaacaaaaaagaagaaaagaagaaagaaaaacaaagaagaagcaaagaagcgtaaaagagacagcggagagcagagagagaagagaagaggacgaacagcgaggcgagagagggaagacggatgagccgaggagacgcgacggagacgaacgcaagaggcagaggaaggagcagacggaagacgaagggggtgggacgaggactgaggaagaaggacggcaggcaagaggcgggtgacgcacgtgacaggagcagaaagcagaacagagaagcagacagcagaaggaaaagaaaaggcagagtgagcgagacagggaagacgacagagaagcaggaggagtaggaagaaggtcagagggagcgctgagtacgaaagaccagtgcgagggaggcagagaggacagacgacgggacgaaaacagcacaagcaagtgctgaggacagcggagaagcagagcgaaggaaacgcgaacagcggcgagggcaacgacaacgaagaggcagaacaagagatacgagggggagaaccaggaagacgaaagaccaacaaggagtagaaggacgtgacacgcgaggatgcaagagggagagaaggagaggacgaagagagggacaggacggaagagccggagcacgacagaaaagaaacgcgacgagggagacgagacaagacgcgaggcgcgagcgaagacacaggggggagagtagggacgaaaagagaacgagacagcataaggcggagccaggaacacagccaccccgccagaaggcaagccagcagagacacaacacgcaccgaaaagacagacgacgcccaccagcaacgaagcaggg

SEQ ID NO: 10954 - DNA, 449 bp, Homo sapiens
tgccatcagtgtgctggagggggaagggggagacagcatttctctgtcctagagcagtgcacagcctgttcatgcacctgtgtgtgtgagtcagctcaaactgccataacagaagaccacagactttgtcttaaacagcaaacatttattgtctcccaattctggaggctggaagtcttggatcaaggcctcagtgggattggcttctcctgaagcctctctccttggcttgcagacagccatcttctccctgtgtcttcacgtggtctttctccgtgagtgtctgtgtcctgatcttttctaataaggacaacagtcatattggattagggcccatcctaacagccttattttaacataatttgctctgtaaaggccctgactccaaatagagtcacatcgtgagtgctgggcgttaggatctcaatatctgaattagggagtggagc

SEQ ID NO: 10955 - DNA, 370 bp, Homo sapiens
tactcttcctgacttaaagtccattttatctgatataagtatacctagttactcctgctcactattggtttctgtttgcttggaatatattttttcatccctttatttcagtctatatgtgtctttaatgataaggtgagtttcttgtaagcagaatcattttttgatcatggatcatttttaatccacttagctattctagcttttaagaggataatttaatttgttcatgttcaaggttattcttgatatgtaaggctttgttcccgtcatgttgttttctcattgtttcatatacttcttgttcctttcttatactttggcattgtgctttggtggatttctgtagtggtagcatttgagttctttc

SEQ ID NO: 10956 - DNA, 494 bp, Homo sapiens
taaactcccaggagagttggcaacccacttctggaaggctgcccacaccttctctaatctgagaccaattgagaactctaacccagctctaaaacaaattctagtcttctaagaaaagtagcaatgatgttagtagtttcctaattttttataatccagaaatgtcactcttatgtggcagtgaattcgcacattcccaaggaaccaagtgactcaacataacacaacagtcacccccaggatgtaatgtgacacgcacaggcccctccgttccaggagatggtttgcccataatctggggacgaaatcgctggaggccttgcatgtgggtgttgcgttactgtgggagggttttgttggcatcaaggctacctttaatgaatgggctttaataaatcaaagagatgtggctaataaatgcgtttcatgacatgccttaaacaaaacaaaacaaaaaaaaaacctcttgtaacttttaaatattttgatttata

SEQ ID NO: 10957 - DNA, 408 bp, Homo sapiens
aggaaggctccaaacaggccattgagctgggctgggagtcataaaagagcctgaggaagagaatgaaggcttcgagaaaagatgaggatggagcatggagtcagggcccaggctagggactaccacagacaactctcttgagttctgaagccacaggtcactaccctcatgtcaccagaatccctgccttctacaagcccagaggcaaggacagagcagcggtgaaaggaccatggatccaactaaacccttctcccatgtgcagtttacaaagctgacttctcaaacttcttccaccttgagaaagatcactcctgcccctcgcaacccgccttctgccccagatcccagacttcaagaacaaccccctatcctctagatcttggttctctggagcaatgagaggcc

SEQ ID NO: 10958 - DNA, 879 bp, Homo sapiens
ctctcttccagcatccagatcagtctgtaaaacatacactgattggcctggcttggttgcatgtccagccctgaattgatctcttggctggaaagacggaatgttctgatggccactctggggcagggaaagagggacccttcattaacagcacctccaaaatcatgtgaagtgggtgagttattggcagttttcaaggaaaagggaagcaggccggaccaaaaaaacaaagccgtagccatctgctattttcaccaagtatagagcagatgtaatgaaaaagacacacacttctcaaaaaattgggaaagtttcagaactctaacaatcagatggaagtcttaaaacttcttaaggaaaatatttaggatacctaaaaagaaacaacaatcaaagtagcatttgatttttcatatgcaatgggcttgctagaaggtaacagagcaatgtctacaaattctgaagggaaatcatttggaatctcttatacaagtgtgaaggcatagtaaagacacatttagaggttcaaggatttggatttatttggtgcaccaccacccctgttatgcacattttctgaaaaattccttgaagatatactctggcaaaatgaaaactgaattcaagaaagagggagacaatagattcaaaaattatagaattaacccagaagaacaatggaaaggaatactagtaggacagttgtgcagctgacctaataagcaattagaacaagaaatcagagggctcataaaaaataacctaaagaagaaaaaagcattaaccatatcctatgagtaagaagctgacatgctggtataagacacttctaagaaacaagaaaagcaaggtatgagacacttctcagaaacaagaaaa

SEQ ID NO: 10959 - DNA, 376 bp, Homo sapiens
aacacagaagaagatgtggtctgtcacctatagtcctgtcattcccttgggtgctcacagttttctgaagagaactctcaaaattctcaaaacataaatacctgtatcccacttcatttttaagaagagtaaagaaattaagtcactttggtattggtatggagacagattttctaagttcaaatagtatactacagcatcttcagacattcatggaacattgtagtatgtgccatcattataaggagatacaaacataggtaaaaagatgtggtgattggaggcaaaactagaatctaaaagaccaagtctgcctttggaaatggaagctattttccctgccatgaaccgagagtgactccgtctcacaaaaaaa

SEQ ID NO: 10960 - DNA, 439 bp, Homo sapiens
atagtccttgctgacatttgatttacatgcagttttatgtcagatcctttaaaatcacaaatatatggagagaaaaatggtatagacaatagaatattctactgggcctataactggtccattaagtgcttatttaaattgtaaacaatcaaatttaatttggtgtttataaaaaattatgtatgtgaacatacattctgttatctatatgtgtctgtaatccattagcttatttacaatgatcaaagaatagaagtgtgaataaatcagaatggcacatgattgaaaatgctgtgtaactgaagatgcatttgtgtagtcttgaatttcatttgaaacaaaattgttagtctgtatcttgaagcacattgctactttgtatttttattgatgtataattaacattcaataaaatgcacataatatccagttcaaggag

SEQ ID NO: 10961 - DNA, 2607 bp, Homo sapiens
ggcacgaggggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagagggagtctgtctccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcttttccttgtcccatcctggggtcaataaaactgaatgttgcatattctagcacttgtctagttttttttttgttccatagaaggcagtttagggtatatcatggagagaatagactttagagtgttatacaacatgtgaatcctggttggttccttccctgcttgatttttgtgcctggttctgccttttactagctatgagacttattaggataagttacccctctaaacctcaacctgattatctgtaaaaatggggatctccacagggtatgttcacagagcaggcatacctagtgggtgctcaattaagtattaattttccttccttgcctatggtcctatgacctgccttcaacatgctgggaaatttaaggcaagaggagaattcaaatacctaggacttaatataagaaattctggccaggcatggtggctcacacctgtaatcccagcactttgggaggccgaggcaggcggatcacctgaggtcgggagtttgagaccagcctgaccaacatggtgaaaccgt

SEQ ID NO: 10962 - DNA, 2661 bp, Homo sapiens
ggcacgaggggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagagggagtctgtctccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattctagcacttgtctagttttttttttgttccatagaaggcagtttagggtatatcatggagagaatagactttagagtgttatacaacatgtgaatcctggttggttccttccctgcttgatttttgtgcctggttctgccttttactagctatgagacttattaggataagttacccctctaaacctcaacctgattatctgtaaaaatggggatctccacagggtatgttcacagagcaggcatacctagtgggtgctcaattaagtattaattttccttccttgcctatggtcctatgacctgccttcaacatgctgggaaatttaaggcaagaggagaattcaaatacctaggacttaatataagaaattctggccaggcatggtggctcacacctgtaatcccagcactttgggaggccgaggcaggcggatcacctgaggtcgggagtttgagaccagcctgaccaacatggtgaaaccgt

SEQ ID NO: 10963 - DNA, 1042 bp, Homo sapiens
ggcacgaggggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattcta

SEQ ID NO: 10964 - DNA, 2178 bp, Homo sapiens
ggcacgaggggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagagggagtctgtctccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattcta

SEQ ID NO: 10965 - DNA, 976 bp, Homo sapiens
ggcacgaggggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacctgatgttttatctcttatcttagaccaggggttgccatttattttattttttttagatggagtctcaccctcccaggctggagacagactccctctcaaa

SEQ ID NO: 10966 - DNA, 731 bp, Homo sapiens
ccttccccagcttactctctgacatgttactcaggtttatggtctttgtaagcttcattattggatatatatttgcttatttgtttacatgtttattgtgtatcttcccctagaacagtgctgacatatagtaagtgttcaacaaatattgtgtggatgaataattgaagagccaggtccctgctgtctccttaaacctctgttactctccataggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttcctt

SEQ ID NO: 10967 - DNA, 2123 bp, Homo sapiens
cacacacgggcgcacgcacacggcagccgggccagggacgaccctgtcagctgcagccccagaggtccggggcgcgcagccgggtcccctcgagggcgcagccggccgccccgccccgcccctcgaagcagccgggccgggcgcgcagtgggctacaaactttcgcagcgcgagtccgccaaggcagcgcgccgactcgggctcggctcggctctgcgctgctccggacggctgtgaccgctggccgggggctcgggccgccggtacccacggaccgcgcgcccgggtgcctgctccgctaagcccctcgccccgcgcggacctcggtatccagcgccctgctgcccgggctctccccgcgcgccctactgccgcgaggtcagtccgcagcctccggtgcgccagcgctcgccttcctcctcctggacttcggccctttgccgccctcaccacgccatggcctggcgcccccaccgcgcggcctgtggcaggccaaggacatctcccccatcgtcaaggcggcccgccgggatggcgagctgctcctctccgcccagctggattctgaggagagggacccgggggtgccccggcccagcccctatgcgccctacatcctagtctatgccaacgatctggccatctcggagcccaacagcgtggcagtgacgctgcagagatacgaccccttccctgccggagaccccgagccccgcgcagcccccaacaactcagcggacccccgcgtgcgccgagccgcgcaggccactgggcccctccaggacaacgagctgccggggctggatgagaggccgccgcgcgcccacgcacagcacttccacaagcaccagctgtggcccagccccttccgggcgctgaaaccccggccagggcgcaaagaccgcaggaagaagggccaggaggtgttcatggccgcctcgcaggtgctggactttgacgagaagacgatgcagaaagcccggaggaagcagtgggatgagccgagggtgtgctcccggaggtacctgaaggtggacttcgcagacatcggctggaatgaatggataatctcaccgaaatcttttgatgcctactactgcgcgggagcatgtgagttccccatgcctaagatcgttcgtccatccaaccatgccaccatccagagcattgtcagggctgtgggcatcatccctggcatcccagagccctgctgtgttcccgataagatgaactcccttggggtcctcttcctggatgagaatcggaatgtggttctgaaggtgtaccccaacatgtccgtggacacctgtgcctgccggtgagaccactccagggtggaaagaagccacgcccagcagagctgccttctcggagccttctgcaaccaggacttgtggtgcagctgcagacacagagcacagctcatgggcaacatcactggggcccagagagagctgtccgccagtgcatcattagggggtctttcattgctagtgactagccccttaaatgccagcctgagtacctgaaggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaataaattaaaggtacagtggtatcttgaaaaactgaaaaatcaaccat

SEQ ID NO: 10968 - DNA, 1572 bp, Homo sapiens
cacacacgggcgcacgcacacggcagccgggccagggacgaccctgtcagctgcagccccagaggtccggggcgcgcagccgggtcccctcgagggcgcagccggccgccccgccccgcccctcgaagcagccgggccgggcgcgcagtgggctacaaactttcgcagcgcgagtccgccaaggcagcgcgccgactcgggctcggctcggctctgcgctgctccggacggctgtgaccgctggccgggggctcgggccgccggtacccacggaccgcgcgcccgggtgcctgctccgctaagcccctcgccccgcgcggacctcggtatccagcgccctgctgcccgggctctccccgcgcgccctactgccgcgaggtcagtccgcagcctccggtgcgccagcgctcgccttcctcctcctggacttcggccctttgccgccctcaccacgccatggctcatgtccccgctcggaccagcccgggacccgggccccagctgctgctgctgctgctgccgttgtttctgctgttgctccgggatgtggccggcagccacagggcccccgcctggtccgcactgcccgcggccgccgacggcctgcagggggacagggatctccagcggcaccctggggacgcggccgccacgttgggccccagcgcccaggacatggtcgctgtccacatgcacaggctctatgagaagtacagccggcagggcgcgcggccgggagggggcaacacggtccgcagcttcagggccaggctggaagtggtcgaccagaaggccgtgtatttcttcaacctgacttccatgcaagactcggaaatgatccttacggccactttccacttctactcagagccgcctcggtggcctcgagcgctcgaggtgctatgcaagccgcgggccaagaacgcttcaggccgcccgctgcccctgggcccgcccacacgccacctgagtacctgaaggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaataaattaaaggtacagtggtatcttgaaaaactgaaaaatcaaccat

SEQ ID NO: 10969 - DNA, 481 bp, Homo sapiens
ggtgagggcggagctgaggtaaccctactccttttctgccttgcagatcgttcgtccatccaaccatgccaccatccagagcattgtcagggctgtgggcatcatccctggcatcccagagccctgctgtgttcccgataagatgaactcccttggggtcctcttcctggatgagaatcggaatgtggttctgaaggtgtaccccaacatgtccgtggacacctgtgcctgccggtgagaccactccagggtggaaagaagccacgcccagcagagctgccttctcggagccttctgcaaccaggacttgtggtgcagctgcagacacagagcacagctcatgggcaacatcactggggcccagagagagctgtccgccagtgcatcattagggggtctttcattgctagtgactagccccttaaatgccagcctgagtacctgaaggaatctgggaattagccctggcctgaaagtggcc

SEQ ID NO: 10970 - DNA, 568 bp, Homo sapiens
aggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaataaattaaaggtacagtggta

SEQ ID NO: 10971 - DNA, 2694 bp, Homo sapiens
cacacacgggcgcacgcacacggcagccgggccagggacgaccctgtcagctgcagccccagaggtccggggcgcgcagccgggtcccctcgagggcgcagccggccgccccgccccgcccctcgaagcagccgggccgggcgcgcagtgggctacaaactttcgcagcgcgagtccgccaaggcagcgcgccgactcgggctcggctcggctctgcgctgctccggacggctgtgaccgctggccgggggctcgggccgccggtacccacggaccgcgcgcccgggtgcctgctccgctaagcccctcgccccgcgcggacctcggtatccagcgccctgctgcccgggctctccccgcgcgccctactgccgcgaggtcagtccgcagcctccggtgcgccagcgctcgccttcctcctcctggacttcggccctttgccgccctcaccacgccatggctcatgtccccgctcggaccagcccgggacccgggccccagctgctgctgctgctgctgccgttgtttctgctgttgctccgggatgtggccggcagccacagggcccccgcctggtccgcactgcccgcggccgccgacggcctgcagggggacagggatctccagcggcaccctggggacgcggccgccacgttgggccccagcgcccaggacatggtcgctgtccacatgcacaggctctatgagaagtacagccggcagggcgcgcggccgggagggggcaacacggtccgcagcttcagggccaggctggaagtggtcgaccagaaggccgtgtatttcttcaacctgacttccatgcaagactcggaaatgatccttacggccactttccacttctactcagagccgcctcggtggcctcgagcgctcgaggtgctatgcaagccgcgggccaagaacgcttcaggccgcccgctgcccctgggcccgcccacacgccagcacctgctcttccgcagcctctcgcagaacacggccacacaggggctactccgcggggccatggccctggcgcccccaccgcgcggcctgtggcaggccaaggacatctcccccatcgtcaaggcggcccgccgggatggcgagctgctcctctccgcccagctggattctgaggagagggacccgggggtgccccggcccagcccctatgcgccctacatcctagtctatgccaacgatctggccatctcggagcccaacagcgtggcagtgacgctgcagagatacgaccccttccctgccggagaccccgagccccgcgcagcccccaacaactcagcggacccccgcgtgcgccgagccgcgcaggccactgggcccctccaggacaacgagctgccggggctggatgagaggccgccgcgcgcccacgcacagcacttccacaagcaccagctgtggcccagccccttccgggcgctgaaaccccggccagggcgcaaagaccgcaggaagaagggccaggaggtgttcatggccgcctcgcaggtgctggactttgacgagaagacgatgcagaaagcccggaggaagcagtgggatgagccgagggtgtgctcccggaggtacctgaaggtggacttcgcagacatcggctggaatgaatggataatctcaccgaaatcttttgatgcctactactgcgcgggagcatgtgagttccccatgcctaagatcgttcgtccatccaaccatgccaccatccagagcattgtcagggctgtgggcatcatccctggcatcccagagccctgctgtgttcccgataagatgaactcccttggggtcctcttcctggatgagaatcggaatgtggttctgaaggtgtaccccaacatgtccgtggacacctgtgcctgccggtgagaccactccagggtggaaagaagccacgcccagcagagctgccttctcggagccttctgcaaccaggacttgtggtgcagctgcagacacagagcacagctcatgggcaacatcactggggcccagagagagctgtccgccagtgcatcattagggggtctttcattgctagtgactagccccttaaatgccagcctgagtacctgaaggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaataaattaaaggtacagtggtatcttgaaaaactgaaaaatcaaccat

SEQ ID NO: 10972 - DNA, 1186 bp, Homo sapiens
cacacacgggcgcacgcacacggcagccgggccagggacgaccctgtcagctgcagccccagaggtccggggcgcgcagccgggtcccctcgagggcgcagccggccgccccgccccgcccctcgaagcagccgggccgggcgcgcagtgggctacaaactttcgcagcgcgagtccgccaaggcagcgcgccgactcgggctcggctcggctctgcgctgctccggacggctgtgaccgctggccgggggctcgggccgccggtacccacggaccgcgcgcccgggtgcctgctccgctaagcccctcgccccgcgcggacctcggtatccagcgccctgctgcccgggctctccccgcgcgccctactgccgcgaggtcagtccgcagcctccggtgcgccagcgctcgccttcctcctcctggacttcggccctttgccgccctcaccacgccatggctcatgtccccgctcggaccagcccgggacccgggccccagctgctgctgctgctgctgccgttgtttctgctgttgctccgggatgtggccggcagccacagggcccccgcctggtccgcactgcccgcggccgccgacggcctgcagggggacagggatctccagcggcaccctggggacgcggccgccacgttgggccccagcgcccaggacatggtcgctgtccacatgcacaggctctatgagaagtacagccggcagggcgcgcggccgggagggggcaacacggtccgcagcttcagggccaggctggaagtggtcgaccagaaggccgtgtatttcttcaacctgacttccatgcaagactcggaaatgatccttacggccactttccacttctactcagaagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaataaattaaaggtacagtggtatcttgaaaaactgaaaaatcaaccat

SEQ ID NO: 10973 - DNA, 424 bp, Homo sapiens
agcaattacaaggacatttagcaaattactaagccatctaggagtaaaaattagtgtttaatggtgttccttcctttgcctgcctagcaatctaaaatgatatatgatatgcatgcagacagcatgccacaaatacttttcctatgcacccagcagttttcccagtaagatcgtaaaaatcagtgcatggcattagagtcttgtgatgttaaagggccttctcaataaatattggatgttggggcagggaatgatgaacttgagcagtaaaaacttaaccacaaaaggttattggtggtggagtagattatgttcttttttaaagttaatttttctattgtatattttaattttaaaaattaaggaggaaaccagaaaagtgaaataaataaaaatgctgtctataccctttaaaaaaaaaaaa

SEQ ID NO: 10974 - DNA, 321 bp, Homo sapiens
ggcccaaacatagatggtgcatctcatcaacattctaatatagagtaatgatcactggctctaaacaaactttgcaaccaaacagaaacttcgtatctgctaatctcacgttgctccccaagaaaaatctaactgaatgttctggaaaagtagtggaaaagttaattgtttgcagaaagttaacttttacctgaagtgacaaaataaagtggttacccaaaggggtaaaacctagcgttggagtttatcttatgggtgtagtagatttgccttaaactcaaagatttgttttgctgggttaatgggtgtccagtggatctt

SEQ ID NO: 10975 - DNA, 983 bp, Homo sapiens
tccctgatgttccctgggggcttcaaggcatttttaatgcacaaaaggaacagagatatataaaagctatagcagctaggccaggcaggatgtttcacccctgtaattccagtactctaggaggccgaggcagatgaatcatttgaggcaagaaacttgagaccagcctggcccacatggcaaaaccctgtctttactacaaatacaaaaattaactgggcatggtagcacatgtctgtaatcccagctactcaggaggctgaggcatgagaattgcttgaacccgggaggcagaggttgcagtgaaccaagatcacaccactgcactccagcctgggctacgaagcaagactctgtcaccaaaaaaaaaaaaaaaaaaagaggggaagaagctatagaagttagcaattttcaaatcaactattttattaagatatacatgaagcatgcaaaatagcacataacgttgaagctaatttgaatgagataaaaaaaacattattgtcaacaaccaacagtgaagaactcaaagcggttctaatgtatttccaaggccatctctcagtgaaatgatattgtcattgttaccatcatcactgtaaaaattctttcaaataatgactaggttctagtatatgctatctcaaatgttagtgaacaaaacctaagtccctgcccacttggagcttacattctagtgggaaaaactaaacactggaagattttatcatttaaggactaaatacaaagtatattgttgtttaacctttttaaaacttactagctatgaacaagttaattaactactttgtactccagtttcatcctctgtcaactaaggataagatagttcctcatagggttcgctggtgaatttaacgaataaagtatatagaacaatgcctgccacacagtaaatgctaaatttatcattgtaatatgctgactcttgataatgatgttggggcagaaaattttaaccc

SEQ ID NO: 10976 - DNA, 330 bp, Homo sapiens
  misc_feature (197)..(197): n is a, c, g, or t
aagttcaagtggcgcgatctcggctcactgcaacctccgcctcccgggttcctagtgattctcctgtctcagcctcccgtgtagctgggaccacaggcacctgccaccatgcccagctaatttttttgtatttttagtagagacggggtttcactactgttagccaggatggtctggatctcttgacctcgtgatcnacccgcctcggacccccaaaatgctgggattacaggtgtaagccatcttctcctttccagagtgaaccaagcaggccttttggttctagatcttggtccaggtattactttgctctgggaggctctgagcagg

SEQ ID NO: 10977 - DNA, 333 bp, Homo sapiens
gccagtaatttgttcattcgctcactgagggtttatcgggtttatcaggtatctcttgcaagcttataattgtgcaagatattgaaaaatgaagtggttgattctagttctaatttcaggaaatattgcttagagagccaatgtttgagtcctttctctactaagtataaatgtgtgttttgcccaggagcctagaaaaatgattgattagaaagattttagttctggaaagttgaatggcctctgtaatcccagcactttaggaggctgaggtggttggatcacttgaggtcaggagtttgagagcagcctggccagtatggtaaaacctca

SEQ ID NO: 10978 - DNA, 291 bp, Homo sapiens
agtagtttgcactaagacagcagcagtagagatgatgagaaataatctgatcctgactatattttttaaggtaaagccaacaggacatgctgatggatcggatatagcagatgatgagagaaacgaaggaatcaaggagaactgtaattatttttgactgagcagttaggagaatgagatcactatttcctgagataggggaagttagtttgaggtcccatgatgcatgcaggcaggcagtgatatatgtgggttcaaaagtcacaataggggtcagggctagagatatat

SEQ ID NO: 10979 - DNA, 453 bp, Homo sapiens
agggaaggcgcgcagcacggatctgcaccccggatgcatctggtgcagcttgtgccgggcctgctgcatgtgggctcggtgatgcccagaccgaagctgcccccctgccgccactgcacagcgcagcatggcctgtggagcggggatttcctgctcagcccgcctcaggtcccattccctccccgctcatcatttcagtaaagggttagtctctggcagacaactggggagaacacagatgtaagaatgagacactgagtttcctctgaattttaagacgaaattttaagaacaaacacaatcaaatgaagaaagtaagttttgattagaaagtaaaaccgttttaataacattaacaggtgcttttattacaaaaatgaacactaatttattgtggtaaatttagaaagaaacattaaaatacaaaataaaataaaagctttcataatccca

SEQ ID NO: 10980 - DNA, 429 bp, Homo sapiens
ggggctaagggatgagaaccctggtctctgcctcaagaatgatttcgggtgggaccagtctccagagacagcccctcgagtctctttggacttggagatcctctttcaaggaataagccaatggtctcattttgtcttctggtctctgcctcaagaatgatttcgagtgggaccagtctccagagacagcccctcgagtctctttggacttggagatcctctttcaaggaataagccaatggtctcattttgtcctctggtctccctgttctaccccatttttttaaaaaattagtcgctggccagacatggtggctcacacctgtagtcccagcactttgggaggctgaggtgggaggagcacttgagaccaggagttggagaccagactaggaaacatagtgagaccctatctctaaaaaaaaaaaa

SEQ ID NO: 10981 - DNA, 241 bp, Homo sapiens
tgtatctaaacatatctaaacatagaaaaggtacagtaaacatgcagtattataatcttatgagaccgtcatcatatatgtggtccactgtttgggccatcattggctgaaaagtggttatgcgacacatgactgtatatatactttcctgttacaacaacagtgtctctcaatccacagtaattgcagcatccagtaggtcttactttagccctgagtcaccatttgtgtcaacgtgttt

SEQ ID NO: 10982 - DNA, 818 bp, Homo sapiens
tataaaggacatctactgtagccaaattaccatcaaacagctgattggtctttgcaaagtataagtgctatattagaagctcagtgtttacctctgctgttggcagctctaagagctagatgagcctgggtaagtaggagctcatgctgttgggcccgtacacagtctccatctctgccagcatgtctactccattcatgtgcccattgtgtcattggagtagcctatgatcaaggctagcagacttccacaaaccacataattttgactgcctagttatttagtgctgattctgtgttgaatgctttctggtggctgtttaacatgaagtatccaaaggtcctaacagtttatgccactcccataggctcatccagaagcctctaccccagaatttcttgcccttaatcctcctatttttctatttcttggcctctgaccaattggtcaagccattcaccacttcttatgaatatactccaactatagactacttttctttctacattcatgtacttcattattcagtttgtacagaaagaaaggtagcctatggttggaatatattcataagcaactaaaatagttcttagaaataaatttatagcactaagaacttccattagaaaagaaaaaagatctcaacctcatcttctacctagaaactaggggaaaaaaacagttaaaaccaaagtaaggtcttggctaatgcaataagacaagaaaaggaaataaaaggtatacaaattgggaaggaagaaataaaactgcctttgtttgcaaatgcctacttagacaatccaaaaaaatgaccaaaa

SEQ ID NO: 10983 - DNA, 161 bp, Homo sapiens
ggaacaaaacaagctctggaaaggagcctagaatccatgaggtcgagcaaggaggcaagccccctgaagaggaccagccctccagagagcaactgagattatgctgggcaggaaagcaaagctagacactgtaagtcctggaaatccagagtagtttaatg

SEQ ID NO: 10984 - DNA, 553 bp, Homo sapiens
tttttttttttggttggagacagggccttgttctgtcactcaggctagagtgcagaggtgcaatcagctcactgtaacctcaaatccctgggctcaagcaaacctctcacctcagcctactgagtagctgggactacgggcacaagacaccaggcctagctaatttttagttttttttgtacagacagggtctcactatgttgcccaggctggtctggaacacctgggctcaagtgatcctcctcctcagcttcctgaagtgctaggattacaggtgtgagccactgtgcttggcccgatatatttttttgccttgttaagtataaaatatttaatcttcagaataataattttggactctgaaatgcctaagagtaaaatatccatctttatcacagaccattactgagaaaggtatgtaacttagccttatgtcacacgcagcttttcagagtttgaggaaatcatgaaggaaaaaacctattgaggttatgataaaatatgacctttgaaaagcttgaaatgacattacatcctaaagacacaggagggc

SEQ ID NO: 10985 - DNA, 321 bp, Homo sapiens
taaccctgttttaattgaattacttccttaatgattctatctcccaattcagtcagattctgaggtcttacaggttaggacttcaacatataaattttggggggacacaatgcaccccataataataggcaaaattgcatttgaaacagaaatttagacacatttcagaaaactaaaattatatttcttgtgcaccttagtagatagacatatggtgagccatcctttgcacttccatgtaactccacatatccacaatcaaaacaactcccaaggctccctagtgtgggatttggcccctttatgttcagtagcaacata

SEQ ID NO: 10986 - DNA, 368 bp, Homo sapiens
tcttaaggccaagtgttgattgtatatgtgggattatttgttgaatattccatctctcctcttggatttgacctgcctcttctcatatttgcatttgagcctctttctggactctttcccatcgtgtgactgtccagggtctgtgttaattatcatggtcttagaatataaggcgtttcaggatgtgacatggcccatctctctccgtatgctccttctttcatgtgaacttcacaattgctctggatgggcctcctgattcattcaaggaacaagccgtcaggcttcagccaggccagagaatgggccgtgggtcccagcactgggctttcatctgggttccatcccattggcctgtgccccagggc

SEQ ID NO: 10987 - DNA, 389 bp, Homo sapiens
agacacctgggtggaggtggagacgtgcaggcaggagctgcccagggccaggcagaggctccagcagcgagcctcacagctgaagggaatgtgtgaggaggggcctgggccttgctctagggagcacctctgaggctgcagggcgtggaaggaagtgcctattccctgatggaggccgggaaggtgccagaaacccagaaatccaacaggaagggctgcaggaagaggcctgctctgctggctgggccctgatggcactcttctgcaacccaacctctgagactcagttttccttcctgccgcagtcccagcatgcagcactgatcagccagcggcagccgcctggggccctcatgaaaagcaccctgtgggttcggcaccaggtccct

SEQ ID NO: 10988 - DNA, 464 bp, Homo sapiens
ctggacggatgtcaagctctttctctaggacttaatcacccggatcctgactggaataatgcatttgataaagtgtctttggggccagttagttttggtgaagacaacagagagtacagatgggtaaaaattcaacaatataaacagagattatgattcacatttataactatggtgagagtttttatttagcaccaaatgggccctacaggaatggtgtgtttggaccacagcctttccctctgctggggattgggacattagtgcttgtgaacagcagggaagttgcccatatctctccacatttggcacaatccctgggcaccatgtgtttttttggctgggagaagctgcaatcagaaatgctagtggctttccaagtccataatggtccaacttgaatgatactaagtctgacatctgtcaaagtgacaccatggtcaggaaagtactcaaggtggctt

SEQ ID NO: 10989 - DNA, 358 bp, Homo sapiens
gctgattaaaccagcataattgacatacaccctcataaacctgggggcaagggtgttaagtgtcgtgtgttgcctgagtatcccatattcaccctggttctagcttggtggaatgtggaatttagacaatttaggattttagagtgggccaggcgcggtggctcacgcctgtaaaagttcccagcactttgggaggccgaggcaggcgaattgcctgagctcaggagttcgagaccagcctgggcaacatggtgaaaccccatcagtaaaagaatctctggactcacaaagtcattcataaagctgcaaactagtcatctctatacacaataaagaaatggcagataaaggggaaaag

SEQ ID NO: 10990 - DNA, 315 bp, Homo sapiens
taaatgttaatcctttacaagttggttttagtggagtaggaaatggcggagaaggctggaggtggattcagatgcaacagggatggcacttacacctttcgatgaaaaagacgtgtgattccgcgattttgcagttgtgaattgtgctgctatacgcatgtgtgtgaaagtatctttttcacataatgacttcttttcctctgggtagacacccagtagtgggattgctgggtcaaatggtaattctacttttagttcgttaaggaatctccacactgttttccatggtggctgtactagtttacattcccacca

SEQ ID NO: 10991 - DNA, 1600 bp, Homo sapiens
cattattgcagccctagcagcactccacctcctattcttgcacgaaacgggatcaaacaaccccctaggaatcacctcccattccgataaaatcaccttccacccttactacacaatcaaagacgccctcggcttacttctcttccttctctccttaatgacattaacagccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggggattgaagtcaccctagctgaaggcctcaccagtgtttcacagaggacacagcccaccccttgcaggaggaggtatctctgagtgtgcagcacagaatcgcatgacccaccttaaccttcctgttgtcatggaaggatgcacggctgctctgtccactgtgattcctagccctctcaagatcactgctttctgaagaatttgcaatgactctggcttctggctgcttatctctggacacccgttctccaccagttgtacagttcatgtaatctacttggcttaattgattttccacttctctcttcctcttctaagatataaacattttaaatgatttattcctgtttcttattctggtgtttctttccttgtccctatgagataagtgtctcaactcactaaatctattcccaatgtataaaataattctaattccattttcagctaaaacatatattaccaagaagaaacaaacttt

SEQ ID NO: 10992 - DNA, 3118 bp, Homo sapiens
tggagcgtctcctgctcgcgcacgccagaagcagctcggggtctctccgccgccccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggtatcagtcagcactgtacactagagggttccatgagattattgtagactcatgatgctgctatctcaaccagatgcccaggacaggtgctctagccattaggaccacaaatggacatgtcagttattgctctgtctaaacaacattcccagtagttgctatattcttcatacaagcatagttaacaacaaagagccaaaagatcaaagaagggatactttcagatggttgtcttgtgtgcttctctgcatttttaaaagacaagacattcttgtacatattatcaataggctataagatgtaacaacgaaatgatgacatctggagaagaaacatcttttccttataaaaatgtgttttcaagctgttgttttaagaagcaaaagatagttctgcaaattcaaagatacagtatcccttcaaaacaaataggagttcagggaagagaaacatccttcaaaggacagtgttgttttgaccgggagatctagagagtgctcagaattagggcctggcatttggaatcacaggatttatcatcacagaaacaactgttttaagattagttccatcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttattagaagaaaattctgattttatagaaaaaaaatagagcaaggagaatataacatgtttgcaaagtcatgtgttttctttctcaatgagggaaaaacaattttattacctgcttaatggtccacctggaactaaaagggatactattttctaacaaggtatatctagtaggggagaaagccaccacaataaatatatttgttaatagtttttcaagttttgttcactctgttttattgtttgttttattgagaaattcttactcttagagactcatgaattaagaaagagaattctgctaactcagagaacctggttcctatgtaattcagaatatattacatttctcagtaatatttgttttttgaatccacctttatctgagccaatggagatttacttatagcgtattaggagatatttattccattttcttattttaatcaacattctaattatagacacatgggcctccctagctgatttcactgctcccccttcattgcttagaaatgggcatcatttcttgtatgtcagatccccctgcatcttcaacatttagtcttttcttctccatattttctatctgtggatctctttaggggattgaagtcaccctagctgaaggcctcaccagtgtttcacagaggacacagcccaccccttgcaggaggaggtatctctgagtgtgcagcacagaatcgcatgacccaccttaaccttcctgttgtcatggaaggatgcacggctgctctgtccactgtgattcctagccctctcaagatcactgctttctgaagaatttgcaatgactctggcttctggctgcttatctctggacacccgttctccaccagttgtacagttcatgtaatctacttggcttaattgattttccacttctctcttcctcttctaagatataaacattttaaatgatttattcctgtttcttattctggtgtttctttccttgtccctatgagataagtgtctcaactcactaaatctattcccaatgtataaaataattctaattccattttcagctaaaacatatattaccaagaagaaacaaacttt

SEQ ID NO: 10993 - DNA, 1110 bp, Homo sapiens
tggagcgtctcctgctcgcgcacgccagaagcagctcggggtctctccgccgccccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggaaaaaataaagggagatgctgtgccgtctcgctccttattttatataattaaaatcaggaaaagaaattgggatc

SEQ ID NO: 10994 - DNA, 249 bp, Homo sapiens
tcctcccctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcag

SEQ ID NO: 10995 - DNA, 2763 bp, Homo sapiens
cggccgcatccccgacacgcaccagcggagccaaagggcgcgcgaggcgatggggttcgcgtgtctgcgcgtttgcagagctgccggacgtcccccgcccgagggttgaagacagcaaaaccccagctgtggggagccggagtgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggtatcagtcagcactgtacactagagggttccatgagattattgtagactcatgatgctgctatctcaaccagatgcccaggacaggtgctctagccattaggaccacaaatggacatgtcagttattgctctgtctaaacaacattcccagtagttgctatattcttcatacaagcatagttaacaacaaagagccaaaagatcaaagaagggatactttcagatggttgtcttgtgtgcttctctgcatttttaaaagacaagacattcttgtacatattatcaataggctataagatgtaacaacgaaatgatgacatctggagaagaaacatcttttccttataaaaatgtgttttcaagctgttgttttaagaagcaaaagatagttctgcaaattcaaagatacagtatcccttcaaaacaaataggagttcagggaagagaaacatccttcaaaggacagtgttgttttgaccgggagatctagagagtgctcagaattagggcctggcatttggaatcacaggatttatcatcacagaaacaactgttttaagattagttccatcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttattagaagaaaattctgattttatagaaaaaaaatagagcaaggagaatataacatgtttgcaaagtcatgtgttttctttctcaatgagggaaaaacaattttattacctgcttaatggtccacctggaactaaaagggatactattttctaacaaggtatatctagtaggggagaaagccaccacaataaatatatttgttaatagtttttcaagttttgttcactctgttttattgtttgttttattgagaaattcttactcttagagactcatgaattaagaaagagaattctgctaactcagagaacctggttcctatgtaattcagaatatattacatttctcagtaatatttgttttttgaatccacctttatctgagccaatggagatttacttatagcgtattaggagatatttattccattttcttattttaatcaacattctaattatagacacatgggcctccctagctgatttcactgctcccccttcattgcttagaaatgggcatcatttcttgtatgtcagatccccctgcatcttcaacatttagtcttttcttctccatattttctatctgtggatctctttaggggattgaagtcaccctagctgaaggcctcaccagtgtttcacagaggacacagcccaccccttgcaggaggaggtatctctgagtgtgcagcacagaatcgcatgacccaccttaaccttcctgttgtcatggaaggatgcacggctgctctgtccactgtgattcctagccctctcaagatcactgctttctgaagaatttgcaatgactctggcttctggctgcttatctctggacacccgttctccaccagttgtacagttcatgtaatctacttggcttaattgattttccacttctctcttcctcttctaagatataaacattttaaatgatttattcctgtttcttattctggtgtttctttccttgtccctatgagataagtgtctcaactcactaaatctattcccaatgtataaaataattctaattccattttcagctaaaacatatattaccaagaagaaacaaacttt

SEQ ID NO: 10996 - DNA, 481 bp, Homo sapiens
ctggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccg

SEQ ID NO: 10997 - DNA, 428 bp, Homo sapiens
aaacatgtatatctaaatattaaataaaacaaaatgtaaagatatctaagatgttaagattttagtaaaataagttaatgaaaaagaaagccagggtctgggaagtatgaatatttaggactactaaactatgggattataagagtgggtaatgacagttagccactcaagaaatacacattttcaagcaccaaggttgtccttgtcaaatgagtctgggctttctgttttctctggcagatctgaaggtgatagattacctaacaccttctgtgatgcttcctgggatctttgtgtcggggtgcatatttagtggaaaaccctctgaataagtcagtcctgaatcccagatggccctgctatgatcctgcaaaggtcatcctgatcccaggattagagagggccactgccaagggcacagaaatgct

SEQ ID NO: 10998 - DNA, 678 bp, Homo sapiens
ggctgagggagacagagagcacgaggagggcaggaaagaccaagggagggctttgtgcaggaggtagggcccgggaagcccagagacaagagcaagcacacggtgctgctgcgtgcagtgagtagcccagctagagggcacggcctgtgctgaggagccgtgggaggaagagagggctgggaaggtaagtgtgtgcattggtgtgtgtgtgagggttcacctgccaattctgagtacacatgaaggctatgtttctgaagatcaccaagtgaccatgtggaggctggcctggacaggcagcctggaggcagggagaccagggaggagcctgttccgacagttgaggccagagtcggggagggctgacctggggcactggcagtggagatgggagggagtgaagctgtgaaggacacacagacagacagagagcagggcttggtgactgatggcaggggtcaggcagagttaaagatgatgacactgtgcacacaaaagacggcgccaacagcaaaaccaccaacagatacagagctgctgggaaggggagctcgaggggagaggagggtgagcacccctcacagagcctctcatagagcctggcacctaacaggcacccagtcacagatggatgcggatggttcacagacgggccatgagctcagcaggctgttttct

SEQ ID NO: 10999 - DNA, 199 bp, Homo sapiens
acacccagcctgagctcagctcagggaggggacaggacatttctgacagaggacacagaggcctgcgctgttaagaggccagcgtggggctgtgaggggacattcatgccacaacctggcctatgcctggctcgcctcagctgtatcctggggtcatgggccccgtgtgaataaaaaagaagaaaaacttgaattctcg

SEQ ID NO: 11000 - DNA, 327 bp, Homo sapiens
tatagatactgagtctcactgtgttgcccaggtgaaaataaatttagaaatttaaactttaaatgtaataattgcaccaggtgagatggctcactcctgtaatctcagcactttgggaggtgaaggctggcagatcacttgaggttaagatttggagaggtcagatcacttgaggacaggagttggtcagcctggccgacatggtgaaaccccatctctactaaaaatacaaaaattagctgggtgtggtggtgcgtgcctgtaatcccagctactcgggaggctgaggcaggagaatcgcttgaacctgggaggcagaggcctgca

SEQ ID NO: 11001 - DNA, 446 bp, Homo sapiens
acacattgtgcaatgattaaatcaagctagttaccatattaacaataaagttaattaacatattaaaataaagctaataacgtattaaccaagctaattaacatattaacaatcaagctaattaacatattcacataatcctaactctgacctatatcacctcacctagttttttttgtggggagaatatgtcaaatctacttttagtcattgtgaaagacgcgatgtattattaactatcatcactgtggtgtgatagatcttggaatttatttgttttatctaactgaaaaaaattaattttaatgtaatttatgtattttttgagacagtctcaccctatagccaggctggagtacagcatcatgttcatagctctcggcagcctccaagtcatggctcaggtgaccctcccacctcagcctcccaggtagctgggagtacag

SEQ ID NO: 11002 - DNA, 284 bp, Homo sapiens
ttttttttttattctgagggctttacttttttctctattagctttactctcttcctctattagtccctgttaattctgactccaagtcttctccttccctggcccacagaggaatagaaagcagtctcatagtttctgtcttgtttcttgaagtaaacacacaattttggtgtgtgtgtgggggggggcttttgctaggagggttttttttttaaataaaggatacctataataatttatcatgtattttccatgtaaactctgtccctctgtctccactttct

SEQ ID NO: 11003 - DNA, 388 bp, Homo sapiens
tttatacctcttttgttttaataccattttgatgtttgtttgtatcttttactatatagtttttgttttaattttagtgcaactcagaagatagaagcactattataaattttacaagcaattaactttagactgatagaaataggtatttaaatgtatgaaaggctgatagagaatttagaatgccattatttctgctgcctctttctcctttggatttcattaataatagtactttcatgccaggtacattttctttatgtagaattgtttttgaaattttcctttgatttttcatcctatctgctgtaattactgtgcatatttaatcatgtccatataagcatgttaattgttcagtgacagaagtagaaggtgacatggcaag

SEQ ID NO: 11004 - DNA, 395 bp, Homo sapiens
gtcccctctcttccccacacccaggttcagcccaggacagctcacacactccatccccagccaggtggggccagggcctctccaacatccccaagctggggatgcttctggcaggatgacgggcctggaagccaagtaactggctgaccccggggacaaggtgaccacgacgaacgacgacacgagcaaaccaggccgcagctgatcctcctgaggctgcaggggccctgtgtccccatccgttccctctgtgcaaaaccttgactccctgaggtctcctgccccaccctgcacccttcttgctctgaatatggaggcaccttgtacttccaggaggcaaaagagccctgagggaacctccttccatttcctgctgtgaggacagcggacccctg

SEQ ID NO: 11005 - DNA, 643 bp, Homo sapiens
cctataatggcctgaactagtttttcaggttaactttggaatacccttggccaagaagaggggtccatgcagatgtttggaggggggggtcttaaagctttatttttagattacagcatattgcttttgcactatcataaagtaaaaacatcataagtcaagccaccataaatagcggaccatctgtatatctgaaagaagatgaaccaagacttggttattgttaaagctgatgattggctgtatgaagatttactatacaattttgtgtacttttgtaagttcttggttgtttctaaacttataacaaaataaataattggccatcttcattggattgtgaagccatttcctcccacatgttcgtaaaaatggtagccatggcccctgactgaacccaggtatgaatggccttcattgattttgtagaccctgaccttctctgttcttccagagaaggtggtactcagataaaaactttgaagcattttattgttcagaatatgactttgatcttctcataagactcaagtttttgaatgcttaaggctctttatcgctagtgtatgtaagtaatatcattgtccttaaccaccatctgcctctccccccagacacacataagtttatgataactacagag

SEQ ID NO: 11006 - DNA, 552 bp, Homo sapiens
cttttcttttcctttcttttctttttttctcttgcagagtgacctttaatacctgggaaggatgaataagcacaacctacattattgctttattttagaaaagagagccagaaatggtagtacattataatatgagttaccataatctctttagctctttaattctcttctcccatttttgcttttgtaaataagacattatcaagaattagagaaattttaggtctatgtgtgagcatcttaacaaatgatagtaggaggcaaaaaataattagttataaagctgtaaaagggaaccaagaaagggaaaataatccgcaataacttaaaaataatcaaacaagaatatagtataaaaggagaaattttcctaccttttggaaaagcaaaaagttccgtttctacattgctgttaggctcaggagattgaataactttagataatttaaacatggaaaacatacaaattatttgatttgaaattttttttaaaaactaccttctttatagtttatttcatatatgtaataaagtacttctacaaaacacatt

SEQ ID NO: 11007 - DNA, 334 bp, Homo sapiens
ggggaccctgagtagggaaagccctttccacgtggctggctttgacacaaacacaccattccagatgtggggagggtcactattttggtttgatgtatggagcccttggtcaggagcagctctgggtagggcactgtgatgaaaatgctattcactaatactgtcaagcagtgaatagtgccaggaactatccaagcagtttcgccctctgccttaatccctaccacagccctgaaagtctcagtgacaatcccatgattttacagatgaggaaaccaaggcaccgagcagctaaatggcttcccccaggactgccttgtggtactcgccgtgg

SEQ ID NO: 11008 - DNA, 876 bp, Homo sapiens
ggttgcagtgagccaagatcgcaccactgcactccaacctggtgacagagtgagactctgtctcaaaaaaaataataataataatgcaaaagtggtgaaattgttttctggactgtcatttacacaaggtattttttaaatgtctgttagacttggagcctgaaatcaagcatatttgaacaaacaaaagactaaacaatcttgagctttgttcccatctacttttgtccttttacataagtccccttgcctacttcttccccctttccatgtgattttttttcctgcaggagaagtgaattgacgttattgagttcctgttttgtgccagcttttattaccttttaatgctttctctatttctagggggtagatagtctcaaagtaagtagttaagtggttggccaatattaccccaatagtggagctgagagctgaacccggttttatctgactcttatatccctgctttctccagtaattttgaaaaaggtgatctaatatacagagttagattttgatgtgatccatttgcatgttctatgtctcaaatgagtcttaattcttatttcttaaacagtggttaagttttaagaaatccatacttagagtactgcagtcagtagtataaaggccttactcttctcctatattgggaagtgaatatatttttcaaagtcgcccattccagatgtactaataacacttaagatatttggccattcattcatttaacaagtattcattgagcatcattatgaaatactacacgaagtatttaatgatgaacagaaaagacaggagcttgtgctctcatggctcttacattataaggaggcaatagattataagcaagcagatcattataacaggatg

SEQ ID NO: 11009 - DNA, 454 bp, Homo sapiens
aggcagggagggagggcctcctgggggcacagcccaggtagcaacatggcaaagtagaaatggacttggaatgatgagctctggaacaatagtaatagcataattggaataattattattgctattgttatgtgataataaccaatcaggagggcattaggcaacgttttacatgtatgagctcaaatgtggccccagctctgacctttcttgctgttgtggctctgggcaggtcgcggctgcactcggggcctcagtttccccactggggcatgaggatttcaagaaaaattccctctagctggaggacactctgtgtgcaaatgcctggaggtgtgtttagaagtggtttggaccccttgactggaatggagtagggggaatcctgttttgccctatgcctcatacagatcagagggtgggaaccttgaacacatcttttttttttttttag

SEQ ID NO: 11010 - DNA, 632 bp, Homo sapiens
ctgttttaagcattttgcctccactacctcctttcagcctcacaacaacctgtgaagtaggttccattatcatcccccttttatagatgaggaacacccctggttaagtaacttgcccaacatatctggtaagttgaagagctagaatctgaatcctggtgtctgtctttgttcccgttattccaaactgattcacttataaaatggagctaattatagcttcttcaggattattacagggattgtcataaaatttgcagataatgcttaacacataataaccactcagcgttttcggaagaagtaggaacttttatttcctttaatgattccattctcttccacagtttccctcactgctttagatagtaactaggtgttattttctttcagtctctgctgtggtgcttctgaaaattactgtcttctgaagtaggtttggggagtaggtcagaacataccttatctgctgtagccaaggacagaaaggctggtttttcatgcagccatgggggtgagggcatgattgtgcgtgttccccagtgggtgttacaggggcctgctctcacaagtagaaaactctgtgtggggcgaagggagatgataagtgatcttatggtgtggcgtctttt

SEQ ID NO: 11011 - DNA, 470 bp, Homo sapiens
ttaccattttagtttttaaaacaggtttattgaggtataattaataaacaaagaattgcacatatttaataaatagccattttgttttaaggacaaattgattcccaggtgccttctgattttcaactaaagcaatgaatttattttgtacattgtgaaggaataaataataagagtgccatgaaattctcctaagaccatagtttatttgcagtatcacagagtttcagtagctgcaaaaaaaaaaaaccttaccaatcctccaggtcaatccccattttgcagattaaaagtcatcctatagacttcactgctgcagagctacctagtggatgagactcaaactccagatatttcctatttgtatttcctgacaataacattttataggaaaaggaatttgtagccacataaacttcaaggtccactcaaatgctacctcctctatgaagcctctcctaatcacccag

SEQ ID NO: 11012 - DNA, 377 bp, Homo sapiens
gacatttggaggctgggggtggtgaggtactaactatggccctcatatccgaatgcagtctttctataaatgccaactgaaaatagtgtcattttgatataattctcttccctattgtacaatgttctagtagtttttaatataacacccatagtttctgaaaacagaagacaaactaatcaattctaatgcaaatttatcaggtggcttataatacagaaatgtcttgaaaaacatttagtttttacctttaaatttttgacaaacaggtaccatcttagtcgtcgaagtaggggacagaaggactgatgatcacaaagctgactgagagtaaaaacatgttttaatttgtcatatttgtatttctcttcgagcta

SEQ ID NO: 11013 - DNA, 413 bp, Homo sapiens
gctaacatgtatttttggatgcctcttttaatagaacaattaataccagtattatgattacctgtttataccaatgtagccacattacttacttttttgtggggggtattgccctttgagattctgatgtaagacctctgacacattgacttacctaaactttttgaggatatacaggttatattactttttccaagataggaatttctgcaccaagtcacacaatgtcaacctatgtcacttcagatttttaagatttaaaaaatctataccactgcagtcagaagcttttggaatctaccatttaaactaataattttcctgttactgaaaagggagttaggcaaagagcaaacagaccctgacggtgatcccaacgaccacgttcatttgaggctgaaataaaatgaagt

SEQ ID NO: 11014 - DNA, 306 bp, Homo sapiens
tgtataatttcatgtttccctctgggatcattttccttgtgtctaaagaattctttagcatttctttcagtacaggtttgctggtgataaattcctctgttttgtttgcctagtagacatctttattttactttcatttttgaagcatatttttgctggtatagaattataaattggcacttattttcttttaatactttacctgaagatgtcactccattgtcttctgacttccatcatttctgtagaaaagtaggctgtaaatcttttttgttgtgccattaaaaattctcttttttctgctta

SEQ ID NO: 11015 - DNA, 1004 bp, Homo sapiens
cctgaagtctgtccgacagatcatagccatgttagtcccacagtcacagaggccaatggattaaattattttatctcccttgagaacaaaaaataaaatcctaagccccccacccgacttaacagaccccctgttggccaacggaacctcaaataaatcttaaaattcagttctcggccatgacaggacaggaggtcagacatacctccctgtacctccctccctcttatggtttagacccaacaactgagcagcattaatgttaaaatagagatcatgagactgacagaacagactctttgtggcaataagacctcaaattataaacagggcctagggccatgccaggcgagggttaagtcttgtaccctactcttaaagaattaactagattctaactaccacatgggttttatttttctctagcagccaagcaagcactggctgtgagagaagcaagattaaaacaattacaactcacccagttcacagacgctgagtaactgatctcctgccccactaaccttaacgacagctttctctggacaagggactgatttcagtaactttctcctgataagagaccatcctccatggactggttctggccagttttagaggctgtgcctttacagaggctgagcctttacagaggctgagtacctttatgtccctgcttcactttttgatgtgtagggcctaattataatacatttaaatgtcaagtctccaccccagaatgaacatgcatgtttattgaatatgcatgtgttaggacctcttttatgagtattctcataaaatgatgtagctcctctgatatcctattgagtatgtatatgtagccaactcatttggctcaaattcctgtcctctccttccctccctggaaatgcctgcctctggccttggctgtaggccacacttcccagcctgtcataatggccaccttgcggactgcaaacctttataagaaataaagctctcttttctaaatttaaaaa

SEQ ID NO: 11016 - DNA, 950 bp, Homo sapiens
cctgaagtctgtccgacagatcatagccatgttagtcccacagtcacagaggccaatggattaaattattttatctcccttgagaacaaaaaataaaatcctaagccccccacccgacttaacagaccccctgttggccaacggaacctcaaataaatcttaaaattcagttctcggccatgacaggacaggaggtcagacatacctccctgtacctccctccctcttatggtttagacccaacaactgagcagcattaatgttaaaatagagatcatgagactgacagaacagactctttgtggcaataagacctcaaattataaacagggcctagggccatgccaggcgagggttaagtcttgtaccctactcttaaagaattaactagattctaactaccacatgggttttatttttctctagcagccaagcaagcactggctgtgagagaagcaagattcactaaccttaacgacagctttctctggacaagggactgatttcagtaactttctcctgataagagaccatcctccatggactggttctggccagttttagaggctgtgcctttacagaggctgagcctttacagaggctgagtacctttatgtccctgcttcactttttgatgtgtagggcctaattataatacatttaaatgtcaagtctccaccccagaatgaacatgcatgtttattgaatatgcatgtgttaggacctcttttatgagtattctcataaaatgatgtagctcctctgatatcctattgagtatgtatatgtagccaactcatttggctcaaattcctgtcctctccttccctccctggaaatgcctgcctctggccttggctgtaggccacacttcccagcctgtcataatggccaccttgcggactgcaaacctttataagaaataaagctctcttttctaaatttaaaaa

SEQ ID NO: 11017 - DNA, 373 bp, Homo sapiens
gtccatttgtgttactataaagggatatctgaagctgggtaatttacaaagaagagaggtttatttggttcatggttctgcaggctatacaagaagcgtgacaccagcgtctgcatctggtgagggtatcaggctacttccactcatggtggaaggcaaaagctagcctgagtgcagagatcacatggcaaggtagtaggaggaggaggaaaaagagaaggaagagagggaggtgctgagtgagaactcactcactcccttgagaataacaccaagccattcatgaggaatctgcccccacaacccagacaccttccactaggccccatcaccaacagtgaggatcagatttcaacatgagacttggtaggta

SEQ ID NO: 11018 - DNA, 307 bp, Homo sapiens
cgtgttttaactatacccccaccaaacatatcttgcctcagattttaaagcaaattccaagtgtcaatcctttccttataaatatttcagtatgtatccttgagtaagtccataaggactaatttcttttagcataactataatgccattaaaacagctactttttagttgcagataagaagtagggtaggaattgctggggtctaacccagttctgatgacattaaatagatcctagatagttggacaaatcatttaactttcttctcttcctgctctcttgtcttttaaagggggaagctcaact

SEQ ID NO: 11019 - DNA, 409 bp, Homo sapiens
taatgttgcttaacaactgaccctcctgaatctcagtagcttgaaacaacaaacatttatttcacatgaacttctcagctccaggcagaggtgaagttcaggcaagctccacgtggcttttgattctaggactcaagctgaagaatcagacacggtctgtgctgtgatattcttgcggtgtatggtagaatacaaaatatatactggagacttgtaaagtctcttagaaccttgttttggaactgccatgctgtcatatttccccacattctactggccaaaataaatcaaattaccaagtccaatatcaatgatgcaggaaagtacacccttctggggcaggggagtggagcagagtgctgggaaaagagagtgcatattttctgaacagtcacaagtatgcattttc

SEQ ID NO: 11020 - DNA, 3303 bp, Homo sapiens
  misc_feature (480)..(480): n is a, c, g, or t
actaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttngggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttatcactgaacccaagtgtttatttaaatgtcaacagtacttctaagaacgttgcctgtcatcgtggtctttggtcttggataactaaactgcctttccagagaaccaaatgtcagagttactagaccaaatagtggttaaaacctccaaaggaagtaatgtaatcttattcataatgggattaacatattttagacattcattttaaacactacctcagttaatatagagtataaaaatctgtggtttaatccctcaaaagttaacagtaattttttttttgtcttacacacacacacaccccctcccccaccatcactatccctgtaccctcaccttggtcatctatcctgaaataaggcttagttagtattggcctgaatgttttgtgttttttttttgttttttttttttactgttactttgaaaaatatgtatgtataccttatcatatctgcctatatcacttactttggggagatactcagagctttgtggttatcagtatactaaaaaaaaaaaaaagtctacgcttaaatttatagtgctatttggtttctccatgatttcactgacaggtctaatacattttctttgagtacttgtttgtaaaaagtagactttatggtgaaaaatacatgcagtgccaagtgattaacttaagtgtttaaaaatattaaattatagcagaagaggttaggaatgatatcagcagtaatagaaataattgagaaaatcatctataaataatagatattacagactatagaataccaaaataatgtcaatactgtagtttttaaagattttaggattaatcttagtccatataaatttgtactattggtaattattgaataattgggaggaatctgggcagttgtgctggttgtaaactatgaatttctaatcgtaaagtgaattgttatttctaattgaactttttttcaagaacagatttcagcctcacatactaagtaaatactgataaataaggaaattagaaatttagtattcataattaaatatgctctaaaatttcctatacttttatttcctgtttattcttaggtagattggaagggggaaacagtctgttctccctaattaaattttttctaataacgattagtagaatatggacattctatatgacagtgacattaaaagaggctctttggaagtatatacattattaacataatgtgtacaagtccttttgaaatgacaactttaatgggtttcagctcttttatctagagcttgagataattcaagctgagtttttcagggcatatcacaacggcaaagtgttcagcagtgggatatcaatgcttatttacattttcctactgctatttatataaaatgttattccattcagaggatgccttttatccccacattaaagcacagatcattaagcaataaaaaccaaattgtctgtcattcaaattataactgcagttatttttgcatggtaagagtgaggtgctaattttgtgtgagatgaactttgtaaactactttgggaaatgttctttggaagtaaggttttttctcctttagtcttatgcttccacttttgtctcagattcacaatccattaaaacatggggaaaaaagaaaaggtaaaattgagagacttttgttagaggagctatttggaatgaaccaacatttcagattttccaaaatgtaagttaggaagtctccattgtctctgcattaacaaaatacactgttactatcttaatctcaagagtgtcattacagtgagaatctcatttaaaagcataccagtgaaattaatagcagtgcttatcaaagaacactgaaatctgtgagaatctttctaggagcattcttttcttcttttagttccaagttccagggtatttttcattcctagtaggtttatatgactcacagaatgtggacttttttcctgtttggagtatttttgtaatgtaagtatcggatagctgcaccacagcatgcataaattgcacattttgttttactttctttatagaatatttaatttcaaaaatataatttatgccaaaaaaagcatacctttcaattttgctacttggttgatttagcacaaaatgcaaagtcttggggcagagagggggagtgaaaaaaattttataggtaattgttacaaaaatacctgtcagaaaccctaaagctgcattgtaaaacaaatggtgtaaactagttttgaaaagtggtaaggaattgtgaaaaaaatctcagacttaatgctctctaaccacatgagtttcttcttttttatttagtaatacgctgctacatatttggaggttctggtgtttgtaggtcactgaacagacattgaaatctgatttatattgtataactgtaacatagaaagaaaaagtatttatattttttctgtaagaatatttcattgagttgtgtataatttaaataagatttgtccccaaatggttttgctcaccttgattttttttgttgtgattttcttgtttttgtataatgtgtatagtttatgtcaagggcattaaaagcctcctgaagcataatcttatcaaagggatacattgttaataaaatgtacttaaaattcaaaaaaaaa

SEQ ID NO: 11021 - DNA, 3370 bp, Homo sapiens
  misc_feature (480)..(480): n is a, c, g, or t
actaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttngggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttatcactgaacccaagtgtttatttaaatgtcaacagtacttctaagaacgttgcctgtcatcgtggtctttggtcttggataactaaactgcctttccagagaaccaaatgtcagagttactagaccaaatagtggttaaaacctccaaaggaagtaatgtaatcttattcataatgggattaacatattttagacattcattttaaacactacctcagttaatatagagtataaaaatctgtggtttaatccctcaaaagttaacagtaattttttttttgtcttacacacacacacaccccctcccccaccatcactatccctgtaccctcaccttggtcatctatcctgaaataaggcttagttagtattggcctgaatgttttgtgttttttttttgttttttttttttactgttactttgaaaaatatgtatgtataccttatcatatctgcctatatcacttactttggggagatactcagagctttgtggttatcagtatactaaaaaaaaaaaaaagtctacgcttaaatttatagtgctatttggtttctccatgatttcactgacaggtctaatacattttctttgagtacttgtttgtaaaaagtagactttatggtgaaaaatacatgcagtgccaagtgattaacttaagtgtttaaaaatattaaattatagcagaagaggttaggaatgatatcagcagtaatagaaataattgagaaaatcatctataaataatagatattacagactatagaataccaaaataatgtcaatactgtagtttttaaagattttaggattaatcttagtccatataaatttgtactattggtaattattgaataattgggaggaatctgggcagttgtgctggttgtaaactatgaatttctaatcgtaaagtgaattgttatttctaattgaactttttttcaagaacagatttcagcctcacatactaagtaaatactgataaataaggaaattagaaatttagtattcataattaaatatgctctaaaatttcctatacttttatttcctgtttattcttaggtagattggaagggggaaacagtctgttctccctaattaaattttttctaataacgattagtagaatatggacattctatatgacagtgacattaaaagaggctctttggaagtatatacattattaacataatgtgtacaagtccttttgaaatgacaactttaatgggtttcagctcttttatctagagcttgagataattcaagctgagtttttcagggcatatcacaacggcaaagtgttcagcagtgggatatcaatgcttatttacattttcctactgctatttatataaaatgttattccattcagaggatgccttttatccccacattaaagcacagatcattaagcaataaaaaccaaattgtctgtcattcaaattataactgcagttatttttgcatggtaagagtgaggtgctaattttgtgtgagatgaactttgtaaactactttgggaaatgttctttggaagtaaggttttttctcctttagtcttatgcttccacttttgtctcagattcacaatccattaaaacatggggaaaaaagaaaaggtaaaattgagagacttttgttagaggagctatttggaatgaaccaacatttcagattttccaaaatgtaagttaggaagtctccattgtctctgcattaacaaaatacactgttactatcttaatctcaagagtgtcattacagtgagaatctcatttaaaagcataccagtgaaattaatagcagtgcttatcaaagaacactgaaatctgtgagaatctttctaggagcattcttttcttcttttagttccaagttccagggtatttttcattcctagtaggtttatatgactcacagaatgtggacttttttcctgtttggagtatttttgtaatgtaagtatcggatagctgcaccacagcatgcataaattgcacattttgttttactttctttatagaatatttaatttcaaaaatataatttatgccaaaaaaagcatacctttcaattttgctacttggttgatttagcacaaaatgcaaagtcttggggcagagagggggagtgaaaaaaattttataggtaattgttacaaaaatacctgtcagaaaccctaaagctgcattgtaaaacaaatggtgtaaactagttttgaaaagtggtaaggaattgtgaaaaaaatctcagacttaatgctctctaaccacatgagtttcttcttttttatttagtaatacgctgctacatatttggaggttctggtgtttgtaggtcactgaacagacattgaaatctgatttatattgtataactgtaacatagaaagaaaaagtatttatattttttctgtaagaatatttcattgagttgtgtataatttaaataagatttgtccccaaatggttttgctcaccttgattttttttgttgtgattttcttgtttttgtataatgtgtatagtttatgtcaagggcattaaaagcctcctgaagcataatcttatcaaagggattccatatggggggattgccatcttggggatctaccacttgcggattccattgggattccatatggggattccatctggggattccatcttgggatccatctaggg

SEQ ID NO: 11022 - DNA, 1324 bp, Homo sapiens
  misc_feature (1244)..(1244): n is a, c, g, or t
cggacgcgtgggcgacccacgcgtccgggattaaagatgatttgcattctttatgagcctctcatggtccagctcacctcaactgtgcgttggtgtggaagatattgcttgttactgactttccttttctttcagattaaaggatcctggtcaaataaaagaggtaaagaaaattacaatccctacagctacggaaatatctttaccaactgctgtgttgccctgtgtgggcccatctcaccaaggtaagactcaggacgcatcgtgctcttcaacagaccttggaaaaccgaatgcctcggccgttagcacaggccgcccgccccggtggaatgggtcgccgccaccacgtgaccactttgtgccgcgtggatgtggccttcgtgaaatcgagatctggctgtttgtcgtgtcacacttcacaccttttttgatcttcaattgaatctgtgtctgattggggggaaatttcctaaagcccaaaatagagagacagatgcctgtggccctgctaatgactgaggccctgctaatgactgaaggtgcgtgcagggagctgtggttagcatcgtcaaggagacaggacacatgtgcaggaaggaagcagccagaagtctgaggaaaccagtttcgaaagttgatttgcacacaatagaaatgttcatagggagaaagccacatgggccgcagtcgttgatactgtggtcatggtaataatgacgatgacacgaaccatggcagtagctgacctttattgaatctgtgttaagctctgctctaagttctttatctgcattagcctttcacaagctcactctgtacctataggtaggcaccgttatatcccattctatggatgaggaaagtgaggcacagagtttaaataatgtgcccaagatcacacagcaagtaaatgccggctagtcaggacacacacccaggccacccaatgtcagagccagtatgtgcccactgaggcacgctgcctccaagtcagagtgtacaagttcaaaatacagattctttgtgagttacacctatggagaatattttcaactgataaatcaaaccatgatcaacaaatagatattgagcaaatctacctggtctctagaatgagtttccaagttattactgcttcctaccttttggtctccaaatgtgtaaaacagggagaaatgacaaaagccaccatgactgtgtccagggcagacccactgtgcacccagaccttaccgatatgngcttgtggaatgcaaacttcatttgattatcagcctcagtgaatcctcattagagaggtaaaaagaattcaagaaaaaaa

SEQ ID NO: 11023 - DNA, 2838 bp, Homo sapiens
gcggccgcccagtcgccagcgctctctcctgggaggatccgctgccggaggaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttggat

SEQ ID NO: 11024 - DNA, 1942 bp, Homo sapiens
ctcagtcacgtggcccctgcacgtgtgcaacgaaggaggccggggtcccagcggaggatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttggat

SEQ ID NO: 11025 - DNA, 1969 bp, Homo sapiens
ctgccctgtgaagaaggtgcctgcttctctttgccttccaccatgattgtaaatttcctgaggcttttccagtcatgtggaactatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttggat

SEQ ID NO: 11026 - DNA, 1642 bp, Homo sapiens
gcggccgcccagtcgccagcgctctctcctgggaggatccgctgccggaggaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatggtaggagtgggggccactgctccctgc

SEQ ID NO: 11027 - DNA, 308 bp, Homo sapiens
aagattgcagtcgtttggggaagtcttacctcgtgaggagggagttgaagagaaacggaggcaagatatgccatgaaagtttaattctctgtgtacatgtgattttcagtggtacttcgagaagtagatcttttcataatcacataagtaacattcagggtatgtggttactctttattgggcataaatgagcttttaaatttcttgtttacgaaatctgtggagattgacgtatggcaaattattcttatcaggtttatcgggacatcaggttcatcttcacaacttttaaccttctcttagattcc

SEQ ID NO: 11028 - DNA, 389 bp, Homo sapiens
atcatctcttttttaatggaagagtttaatttgtcaacatttattttggttacttgtatatttggactcatttctactatcttagtttttgttttctatttatcatccttttcttttgcttttttttgagacagagtcttgctctgtcgcccaggctgaagtgcagtggcgtgtgatctcggctcactgcaacctcagcctcctgggttcaagagattctcctgcctcagcctcccgagtagctgggattacaggcatgcgccataacgcccagctaattttttgtatttttagtagagatggggattcaccatgttggccaggctggtttcgaacccctaacctcaggtgatccacctgtcttggcctcccaaagtgctaggattaca

SEQ ID NO: 11029 - DNA, 439 bp, Homo sapiens
gtcagatctctttgaccatcataattttcttggttataatttttgcaatgacagtatcagtgagcccctgtctttactaaaaatcaaaacaaaaaaaaatttttttaaacctggtgtggtggcgcatgcctgtagtcccagctactggggaagctgtggcaagagctcttgagctgtgttcatgccactgcagtccagcctgggcgactgagcaagaccctgtcaaaaaaaaaaaaaaaggaaagaccctgttatagattagaaagagcactggacttggggccaggatgtttgtgtaaatgtccctgtgtgacctttagtgagtcacttagccttttgtaaaccccagccacagcatgactgcatcactggttcctttgaaccccctgtgttccatcagcctgctggaacagtccaccatgcagggcgcttggtactc

SEQ ID NO: 11030 - DNA, 462 bp, Homo sapiens
acctcaaaaagtaaatcagtgagtggatgtaggaattggggtaaatgagcaatagctgccttgtcatttcaagttctgtgtcttactcctatttcacaatcctttcataggagagagagagagagttttctttaaaggcaaggtttgtgggtaagaaaaattattgaaataatgtaggaataactcaaaaccagagaagcctttgactcagttcaaagaggctattaggaggaaattgactaaagctgtacagactctaagacctgggcacttacattcctttgcatttcttgaagaatgctttgaattcttgttctactcctaggaggctctcgaacttcagatactaatctcaaaacgagttatggagtccagaagacatcaattccctgtgacaaacagaaaactaatttacattcctgctgaaactctgtagattttattttctcaggaaaaaaaaaa

SEQ ID NO: 11031 - DNA, 248 bp, Homo sapiens
ggtcgacgctggaatgaaagtgaaacatagttaacaacttttgagagtcgtgaagccagcattcattagtggcaccatggatgatgtaaagagcattgactaaatgatattagaaaactacagaaacagtccgggtgaggtggctcacatctgtaatcccagcactttgggaggccaaggcaggcagatcacctgaggtcaggagttcaagaccagcctggccaacatggcgaaatcatgtctctact

SEQ ID NO: 11032 - DNA, 338 bp, Homo sapiens
caggaagcaaagaaaaaaagtatgagcacgtgtgtgtttactttccaagaccaggcagaggctgttgattatttggaaaaccttggaagacctttaagtggccacggtgacccaagtgaccttcgaggagacaaagtctgcatctttgcgcccaaatttgccaaaggcgttgccagagacatctttctagaagaagctagaacaaaataaaagtttctgcaaaggaactttttgagcctgtaactagagcacaagctgcttccggggaaggcggagggaacacgtgggcacattgagttgcacgtggacgcggagtgcgcaggcgtgcgctgaggcca

SEQ ID NO: 11033 - DNA, 430 bp, Homo sapiens
tcttcataaccttagaagaggctacagtttcttaggtatgacatgaaaagcacaaggaataaaagaatagataaataaacttaacatcataaaaattaaaaacatttgtgcattaaaagacattatcaaagggccaggggcagaggctcatacctgtaatctctgtgcattgggaggccaaggtgggcggatcacttgaggcaagcctgcccaacatggcaaaaccctgtctctattaaaaatacaaaaattagccaggtttagtggtaaacatctgtaatcccagctactcgggggactgaggcatgagaatcacttgaacctgggaagcggaggttgcagtgagccgagattgtgccactgcattccagcctgggcaacagagtgagactctgtctcaaaaaataaaatacattaaattataaaataa

SEQ ID NO: 11034 - DNA, 408 bp, Homo sapiens
tcttcatatgattttgtaaatcatgagtgaaagctacttaaacagttttgttttgttttcttaacataacaaaattagagcacttgatctggttttcatgttagtgaatttcaatgaaaagattaacagaggccaggcatggtgactcatgcctgtaatcccagtacagtggagagaccaaggcgggcggatcccttgaacccaggagttccagcttggacaacatggtgaaacccatctctacaaaaataaaaattagccaggcgtggtggtacgtgcctgtagtccccactacttgggaggctgaggtagaaggatcccttgagcccaggaggtggaggttgcagtgagccgagattatgccactgcactccagcctgcgtcacagagttgtttttgttttgtttt

SEQ ID NO: 11035 - DNA, 408 bp, Homo sapiens
gggagcaagacacagtccctgccttttaaaggaagtctagcatatttgggtcactcgtgtcaagttttaagaattaatattagattcttgagctacattatggcaagtttctgcaaatgttaatggctgaactatctcaagataggcagtgaagctggatggattcaattatgttttataagaccacatttgtatacttctgtgctctccactgtgttgacttttcaggatatcaggttgaaaagcaggccttgtgggatgtaattataaaagctttttttttgtcactttcaaattactttttttccctttttgtctctttcaatttactctttgagactggttcatcctctttcatgggttaacttaatttttctggttgcttttagataatacaaatcatccttc

SEQ ID NO: 11036 - DNA, 394 bp, Homo sapiens
ggcaggtggctccctgctcaaggcctccctattcgtggtctctatacttgctgttccttcaagcaattgatcacataaaacagataacaagccgttaatgactttcaagttgtctggaatgttttttactcaaatactccaaagcataatacctcatcttctttaagtctttgcttaaagattatgtaccatgtgattatgtaactcatggtacataatcagttctctgattaccttatgtaaaacagtactgtctattccctttctctgatttatttatctccatagcccttctcaccactcacataggatatatcttgctttcttgttaaattattttatttatttaatgcttattgtctttctctcccattcatatgaacggcagtttttt

SEQ ID NO: 11037 - DNA, 1394 bp, Homo sapiens
  misc_feature (1394)..(1394): n is a, c, g, or t
cccttctataagggcatcttcgtgacgtcgtaggctgccgttctgggtccccgggtccgagttagtcgctacgaaacggccggccgcttcgaccaagacactccttgcttcaggccactccagacagcgtgtgctgaagggtgccctgggtggtcagaaacaagtgcatgaactttctctttgaagtgtttttgtccctgtttcctagagttcttggcattttacacgtctttctttctttttttttttttttcatattaaacttgtagttttattcaggtttgattttaacaaatgtgtcggggagagagcccgcagggaagggtaaagcccatgggggcaggcccttcccagatgcctgaggagggggcaggtcccctcccctctcctcttcttccctccccatctaaaggggtttggggagagacacaggcaggcgagggggctggtccccagtctgttgggtggtgctcagggtaaagggctatgggcaacaggggaccagaccaaggatgagtggggagggcacaaggaccatttgccagaatccaccgctttctgattccagattgaatttaaaaaaaaaaaaaaaaaaaaaaaaaaaaagtgtggtgggcggccttggggcccggaaaaagttttaaaaccattcgcgtggggggggcggggccccagagggttaggggaccaggggcaaagggcggtccccaaggaggaaccccgggccggacaggggtgggttcccccccaataaaaaaggggccggggggggaaacccgagggggtcttgggaccaaatccacagaggggaggtccaggagggccagatacacgggaggctctacctcacgaaggggggcccagggcgagagcccggaaaactaaaattacgccagcgcgcgcggggtggaggggaagacaaccagcaacagaagacacacgaacatcagcacagcacagacacgagcagcgccgataacagagacgacggaaacagtaaggagacgagtcgacgcagcaagagcagcaaacagcagaacgaaagcgacacggcagccgacggacaatcgaagaggaaacagacacgcaagaggatagatcagacgcacgcaggaccaggcgacaacgaacagtgaggaaggcagaccagagcaagaaggatagagcaacaagcgggcacacagaaaggaggaatcactcacgagagagcggaggcagcgactggagaagagccgaagaggagaggacggcagggcacaacagagagtcagagcacagacgggagcggatgaacaagagacagggacgaagagagcaaagacggacaaagacgcagagagaggagacgagagaacagcagatcgcaagggagcagaacaagagaagaagagagn

SEQ ID NO: 11038 - DNA, 482 bp, Homo sapiens
gaaaatatagttgtaaagttatttatataaaatcacatttaacctgtaacgtattgtaagatgagtgttggtgaaacaccttctttgtctggggaataacctgtggtttgttgccttgagccaggaaagaattcagaacatggacacatgggtgggttaaggagcaggaagtttagtagtggaaaggtgagaggaagaggagaacagcttcttgcaagagagaggagatagagggagagcgagacgtctggaaaaaaggaggatcaataacaagttctgaaattgaggcagtaattaatatcctaccaaccaaaaaaagcccaggaccagatggattcacagccaaattctaccagaggtataaagaggagctggtaccattccttctgaaagtattccgaacaatagaaaaagagggactcctcctcaactcattctatgaggccagcattatcctgataccaaaacctggcagagacaca

SEQ ID NO: 11039 - DNA, 452 bp, Homo sapiens
tgtctaactaactaactgcatgaatgaaaacttattttccaaaagacagctccctctgaggcccacaattttgtaaataataacaacagaaatacatttccccactgaattcctgagaaaagaattcgcctaattatataaactccccactgctccttacatcctcttttccccaggcactttaacatggactcccaaaatgctttggctctcccactctcctagtatagcagatggagtgcttgggagtgtctgatttagagacaagaaggcaagagggagacgggcggcagctagaagcggcccatcctcagagtgtatgcaagacaggaagtgtctgaatatggaccaaatcaaaggctgaggcagctctgggggagccctgtccggtgtttgaggaactcgaagacacaacttctaagacattcttactacagcacaaaagtctgtta

SEQ ID NO: 11040 - DNA, 630 bp, Homo sapiens
catcccaaagaactgggattacaggtgtgagtcaccactgttggtgtgtcctaaattttaatggctattttggtaccttaccagttctttgaaggaatacctgtatttattgagtggctgtgagctagttgtagtgctcagtccttgggtgggtagctttatctaatatgagtatttttagtttagaaaaatattgtgacttatacagttaactccatttattaatgtcactaattgatgaacaaatttttttgtattaatctgatgcctttgcccttgtgttgaacatgggttaagaaaatgcttttcaggctgagcatggtggctcatgcctataatcttcaacactttgggaggcccagccaggcggatcacttgagcccaggagttcaagaccagcctggtcagtatggcaagacctcacctctactttaaaaaaaaaaaatagcagggtgtagtgtcacatgcctgtagccccaattactcaggaggctgagccgggaggattgctttgagcccaggagttcgaggctacagcgagctataatcgagccactgcactccagcctgggcaaccgagggagaccttgtctcaaaaaaacaaacaaacaaacaaaaaaacaaagaaaa

SEQ ID NO: 11041 - DNA, 381 bp, Homo sapiens
cctgaacctcctgggctcaagcagtcctcctatctcagcctcctacctgtagctgggactacaggaacatgccaccatgcccagctaatttttaaattattttttgtagagacagtgcctcactgtgttgccccaggagttcaagaccagcctggtcagtatggcaagacctcacctctactttaaaaaaaaaaaatagcagggtgtagtgtcacatgcctgtagccccaattactcaggaggctgagccgggaggattgctttgagcccaggagttcgaggctacagcgagctataatcgagccactgcactccagcctgggcaaccgagggagaccttgtctcaaaaaaacaaacaaacaaacaaaaaaacaaagaaaa

SEQ ID NO: 11042 - DNA, 461 bp, Homo sapiens
tcatcagcaccacagctgagtgttacctgggatgggctgtggtgccactccggtgcctccctccttcttctatcctacagggactaccatgaatcctacttaccgcactggagagctgtgcagatggaaggaagtgggagatgtggaaacactttcaacaactgaagcagcaggccaagaaaaggtgtcaatagctgtgcttttgcccacaaaaaagtgagtcttcttcattaatgtatgtcttgaacatggaacccgtcccctccaggttgttgactgggctgtgccccctgttgtcagagaagtgtcagtgtctgggaccatctactggtgatatttccctgctcagaagagtcatgaccacagaccccaggcatttcctcttggcaggcactgtgcccagagttttaggaacaggctcactgagtccatacatcagaaggtaggtcctagggccactc

SEQ ID NO: 11043 - DNA, 448 bp, Homo sapiens
ttcttaaatcacctccacttacacacattgttaagcatctaatagaaaacaaccgtcccttccctagttcttttcctctttggattgctttttaagagcaagttgggaaagtctttgtttttatgggccccagttcccatttccaatctcacctccatgctccacaacccccctgaattaaagaaggtctccagcgttgtcaatcaacccaccatgcaccaggccataaaatcttattttcagccacctgcaggatgatggagggaagaggaaaccgaactgaggaagaggcgggagcagagctgcagccggccgctgaagatggtttcaacagaattctttggcgggtggaagggtgcggagtctcgggtcatttcctgcgaggtctgggctgtatggggggaatctgtaatagcactgcctcacagttccattagtgtcagaactc

SEQ ID NO: 11044 - DNA, 1919 bp, Homo sapiens
ggcctggccgtgttaggcttcgctggcgtaaagtccccgggagctttgcccctcacggagaacgttagttgaccctgatggggacccgtagggtaaaggttttgttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctgggtaaaagtcgtccaagtggaacttcctttggtcgggggtctgatactcgaaggaaacggtctttcacttctgggttagggcgtccgcccagagggcgactgcaatgaaggaaattgtgccctgcgacttcccgtaacagagctgtgtgtccacgctcccttttccgagcaggcgcggacgcttgtgcctggaagtaaacttgttaacggttctttgccttttggggaggggagacagcccagagaaggctttggagacccttgagtcggccagcgagcagggtttcttacttgagcgcctccacaaataaacgctccttcgctcctccgtcgcgtgcgtttccctgggataataagtgggaaagtggtggcttttatttttttgagacagggtctcaccgccgtcgcccaggccggatggagtgcagtggcgcgatcacggctcactgcagcctcgacttcccaggctcagagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactggcatatttcacatagcataatctccttgtggtttatccatcttgtagcatgtgtcagaatttccttcccttttaagactaaataatattccattgtgtgtatataccacttgtgttatttccaccttttggttattgtgaataatactgcttcaaacatgagtgtacagataactcttcaagatccttttagggtaatacagagatagtaagtt

SEQ ID NO: 11045 - DNA, 1722 bp, Homo sapiens
ggcctggccgtgttaggcttcgctggcgtaaagtccccgggagctttgcccctcacggagaacgttagttgaccctgatggggacccgtagggtaaaggttttgttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctgggtaaaagtcgtccaagtggaacttcctttggtcgggggtctgatactcgaaggaaacggtctttcacttctgggttagggcgtccgcccagagggcgactgcaatgaaggaaattgtgccctgcgacttcccgtaacagagctgtgtgtccacgctcccttttccgagcaggcgcggacgcttgtgcctggaaggtctcaccgccgtcgcccaggccggatggagtgcagtggcgcgatcacggctcactgcagcctcgacttcccaggctcagagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactggcatatttcacatagcataatctccttgtggtttatccatcttgtagcatgtgtcagaatttccttcccttttaagactaaataatattccattgtgtgtatataccacttgtgttatttccaccttttggttattgtgaataatactgcttcaaacatgagtgtacagataactcttcaagatccttttagggtaatacagagatagtaagtt

SEQ ID NO: 11046 - DNA, 1448 bp, Homo sapiens
ggcctggccgtgttaggcttcgctggcgtaaagtccccgggagctttgcccctcacggagaacgttagttgaccctgatggggacccgtagggtaaaggttttgttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctggagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactggcatatttcacatagcataatctccttgtggtttatccatcttgtagcatgtgtcagaatttccttcccttttaagactaaataatattccattgtgtgtatataccacttgtgttatttccaccttttggttattgtgaataatactgcttcaaacatgagtgtacagataactcttcaagatccttttagggtaatacagagatagtaagtt

SEQ ID NO: 11047 - DNA, 1637 bp, Homo sapiens
ggcctggccgtgttaggcttcgctggcgtaaagtccccgggagctttgcccctcacggagaacgttagttgaccctgatggggacccgtagggtaaaggttttgttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctgggtaaaagtcgtccaagtggaacttcctttggtcgggggtctgatactcgaaggaaacggtctttcacttctgggttagggcgtccgcccagagggcgactgcaatgaaggaaattgtgccctgcgacttcccgtaacagagctgtgtgtccacgctcccttttccgagcaggcgcggacgcttgtgcctggaagtaaacttgttaacggttctttgccttttggggaggggagacagcccagagaaggctttggagacccttgagtcggccagcgagcagggtttcttacttgagcgcctccacaaataaacgctccttcgctcctccgtcgcgtgcgtttccctgggataataagtgggaaagtggtggcttttatttttttgagacagggtctcaccgccgtcgcccaggccggatggagtgcagtggcgcgatcacggctcactgcagcctcgacttcccaggctcagagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctccttgtgctccacttctcaaccactgcacttggctagtcttaaac

SEQ ID NO: 11048 - DNA, 1529 bp, Homo sapiens
ggcctggccgtgttaggcttcgctggcgtaaagtccccgggagctttgcccctcacggagaacgttagttgaccctgatggggacccgtagggtaaaggttttgttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctggggtctcaccgccgtcgcccaggccggatggagtgcagtggcgcgatcacggctcactgcagcctcgacttcccaggctcagagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactggcatatttcacatagcataatctccttgtggtttatccatcttgtagcatgtgtcagaatttccttcccttttaagactaaataatattccattgtgtgtatataccacttgtgttatttccaccttttggttattgtgaataatactgcttcaaacatgagtgtacagataactcttcaagatccttttagggtaatacagagatagtaagtt

SEQ ID NO: 11049 - DNA, 1383 bp, Homo sapiens
  misc_feature (1206)..(1206): n is a, c, g, or t
tataggctaggtacgggctgggtttgaattcggccgaggctccagcatggaggaggccaccggctgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttncagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtc

SEQ ID NO: 11050 - DNA, 1889 bp, Homo sapiens
  misc_feature (1712)..(1712): n is a, c, g, or t
gccgagacgaggacctgtcccgcggacggtctccggctcctgcgacaccgacgccctggtggaggacctcctgtccgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccggctgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttncagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtc

SEQ ID NO: 11051 - DNA, 1952 bp, Homo sapiens
  misc_feature (1775)..(1775): n is a, c, g, or t
gccgagacgaggacctgtcccgcggacggtctccggctcctgcgacaccgacgccctggtggaggacctcctgtccgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccggctgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttncagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtc

SEQ ID NO: 11052 - DNA, 1402 bp, Homo sapiens
  misc_feature (1225)..(1225): n is a, c, g, or t
cctgttgctgtttctgctcccagggaggcaggcaggagtctgtcctcttcacagtggccctcatcttactacctgcctctcttcccctagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttncagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtc

SEQ ID NO: 11053 - DNA, 1182 bp, Homo sapiens
  misc_feature (1120)..(1120): n is a, c, g, or t
  misc_feature (1130)..(1130): n is a, c, g, or t
  misc_feature (1174)..(1174): n is a, c, g, or t
gccgagacgaggacctgtcccgcggacggtctccggctcctgcgacaccgacgccctggtggaggacctcctgtccgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccggctgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatggggaagntggtcagctnattgcgaagtcagtagcagcttatgttttcacatgacctaattntgctgctg

SEQ ID NO: 11054 - DNA, 416 bp, Homo sapiens
gcacaccctccagctcaacacattaacgcaataacaacacctacgtggctgggactgttaatgatttaaaaatttaaattatgtgtaatgatatttcacaaattaatgatttaaaaatttaaattatgtgtaatgacatttcagaagataaaagctcccctggggctcaaccatggcgatttgtagtggagtcacagagccatctatacatccagtagcagaatgttggggaaccgtgctttgtcacttcgtggggtacagtgacatcccttcccaccccaaacttattaatcaggagattcaggtggacttctgaggtgggggcatattgctggcactagcctgggttcttttccctctcctaccattaaagccctgatgtcctccaccgaaaggggtgtaggatcattgtggta

SEQ ID NO: 11055 - DNA, 326 bp, Homo sapiens
aactttagaacctggaccctacctaggaagattagcaagtacacaccactgaggaaggactttaaagaaatatttagctattttcagaaaaaaggctccagtacttcagaatttataataaagatgtgtgttccaaatgttgtaactgttccattaaaagtgatgctaatgaatcatagaatcagtttaatttcactaaacttagtttttactattttcaaagctatacaaacaaatcaatatgaaattacatcatgtttttgcattttatcatggttctcatcacttcctctatataaatgaagagaagaagcagtaaaattcaa

SEQ ID NO: 11056 - DNA, 413 bp, Homo sapiens
tcctcctgggtctactcagcttgtccctctattagggcacccacctaccccccttcacctccccaacacttcctaatccctaaactaagctcagggaggcatttgtcatctctgcctggctcagatgagatgctctgccctgagtactatgagagattgggaagcaggattctatgtaggatggttaggagcctggggcttgtcatgagtaagaactgggtttgaattccgtatcctcaactttcaaatgttgggacctctgaaattgctttaacttctctcagtgccagttttctcatctgaaaactgaggatagaatacctacctagtaaggggggtatgggaaatgcatgtaaagtatttaataagtgctcaataaaataaaaccattgatttatctcatcatagcctgt

SEQ ID NO: 11057 - DNA, 407 bp, Homo sapiens
tttttttttctcctctgtatgtaaagcaacatatttctgcaccatttaagagaaaagaaaatgagtcagtgtgagctgccaacagctggctgacaaccttgagcactgggtgggttggaaaccatccagactttgcataaggagttcattttgggttagttaaaaaaaaaaaaggcgggaggtgggggaaggagttggcccagatcctgttccacaaattcaggaacaaggagttgagattcccttcagaaactgctggagggtggctctgcaggtccgtttgccaaacactatttgacatctgcttgtttccctgcctgacacaagaagaaccgttaactgtccaggtttttcctctgacaagccaatgattcaatgcagcagttgaaccatgtgaaggttaattc

SEQ ID NO: 11058 - DNA, 233 bp, Homo sapiens
tgtcttccaggagcggatttccaaggcccgccacgagactggagtctgagtcttccggtccaggagggaaccgcgctcggccccgcagtctcctcccctgcctactaccctccccagcctggcggctcagagcacgtgcggccctgagcccagctccccctcgtctccaatgtccacctcgtcctctggctcggtcagcacgaagggaccggcgggcaggctcagccgagcct

SEQ ID NO: 11059 - DNA, 355 bp, Homo sapiens
caaagatgctgtcagtctaggcagaatctgggccccacagagtggtaggcagaatgcaggtatcacctagcagccaggaatggtcaagctagcagagagagaaaagccatgcttcagaaattaaaaacttctgactcttcctgtctaaggaggaattggcagctggctcccaaggccctgcttcccttcagacctaactggtgtttgtgtttgtttgactatatatgtattttttcaagtccttctgtgcatgtctgtgtctgcatatgcctcacattcagtgtacttgtacttcatagcattaagaagaattgtctgattcacttaagttcagtgagtttcctttcatttcctt

SEQ ID NO: 11060 - DNA, 503 bp, Homo sapiens
ttgtattttttaaagtattggtcctcaacaaaattggacactttataaagtggtcctcacctcaaatcatttgagaaacacggctcaaagcccttgctgccaattgacagacaggcttgtttgtgtttgttgttcatcctctgcctccccaactccaccgcccactccacgtggcaaggattcactgggctttgttcactgctgattccctgggcctcaatgtatatctggtgagtgaatgaatggataaatgaagcaatcaacctcaagtaggtctcataactttctggtcacttttgattattgaatctgcatccgccaggtgcggtggtgtgcacctgtagtcccagaacttgggaggctgaggcaagaggatcacttgaggccaggattttgaggctgcagtgagctctcatgacactagtgtactgcagcccaggcagaaaaccaacactttgtctctaaaaacaaaaataaagaaataaactcaatccaatgtcctt

SEQ ID NO: 11061 - DNA, 566 bp, Homo sapiens
caattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaaggtttgtaggaggtgatttatgacaaatcacattaacgttgaagttacagctttttaaaatcagggcagaacctgtcttctctttaataacatcctgagaaatacaggagccatgggtcctctgctgagttgacacagtgtacactgatctcaggccgaccccgtcatctctgtgacttttccttggttctataaatctgggcacattatagatcctggctcaa

SEQ ID NO: 11062 - DNA, 1109 bp, Homo sapiens
caattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctctgtgacctcccgagcccaggactggagttgtctggagaccacgcgtctaaccaaggagctgtgaacgctcaggacccagaggggctgtgatgaaagagaaggccagctttctcccgcctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaaaagctgtgcccctaagcaggtacatggggatcctct

SEQ ID NO: 11063 - DNA, 1092 bp, Homo sapiens
caattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctctgtgacctcccgagcccaggactggagttgtctggagaccacgcgtctaaccaaggagctgtgaacgctcaggacccagaggggctgtgatgaaagagaaggccagctttctcccgcctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcaggacaagggtccctaggaaacaggctctgcagagactacatgagagaaaaactcgaatcatgggcgtggtagggcgtgcgcctacacatatgggagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacggtggcatcaaagattccctctgccacagatctgatagataacaggaaagtaccactgaatccgcctggaaaaatgaaaccaagcaaagagaaatcgccacaagcaagtaaagaaatgaggttggtaactgcaact

SEQ ID NO: 11064 - DNA, 319 bp, Homo sapiens
atttatcatgtatgccataatagtgggcttttccttcagatcagaacattttaaatttaaaagaaggagtcttgcttcaccacttttgagctcaggctttttttggaaactcattcaattgcccagcactgtgatcacctagagggcatatgcacactcaaagcatggaccctgagctgtcaccaggtgcagtgctatctaccatccaccagtggtgccagtgttgaatgatgggggaaggcttgagttcttttattaggctgggtggcagttaccaacgtcttcatttcagcttaaattcacatggattctttagcag

SEQ ID NO: 11065 - DNA, 783 bp, Homo sapiens
agcttgaaactacattattagcgtagttcttgtgggttcctgtgtttaatgcttgcctggttcttaacctatattagctttctgtgtgtttaaaaaaaatctttatcttttgtgtaagtcggttttccttattcttacacactttaatgtatgtaggctgctctgttgtaaagaccatctgtcttctgctgggctgaggacctctgtgcatttccactctttgaccatctcaggacaggcacaacaaaaaaatgttaaaaacttggatgttgtcatggatatgtggatgctttacattgtgtgtgtgtgcgtgtgtgtgtaattttagtgtgaaaaatggtatcaggtttctccaaggcaacaaaaccattaggagattttgtatataacagatagatattatatgtaatttcaaggaattagtttacttggttgttggggctggcaagtctgaaatctgtcttctggttgagctggccattgggttgggaactctagcacaggagctgatgctgcacctttagccaggatttctcaggaaatcccagtttactgccttgtaagtgattagatgagacccaaccacataattgagggtagtctcctttacataaagtcagctgattgtaggtttaaccatatctacaaaaatacctttatagcaacacctagttagtatttgatagaataattgaatactgtggcaaaattgtaacataaaactaaccatcacagatgagtatattatttcacaatagattgtccttcatatcagcttcttga

SEQ ID NO: 11066 - DNA, 482 bp, Homo sapiens
tttttttttttgagacagagttatctagctctgttgcccaggccggagtgcagtggcatggtctcggctcactgcaatctccgccttccgggtttaagcaattcttctgccacagcctcccaagtagctgggattacaggtgcctgccaccatgccaggctaattttttgtatttttagcagagatgaggtttcaccatgttggccaggctggtctcaaaactcctgaccacaggtgatgcacctgcctcagcctcctaaagggctgggattacaggtgtgagccattgcgccctgcctgctcaaattatttagtgaaaaaattgtgataaaagtttttaaagttttagaatttaaaggtaagcaaacttcacaaacctatcttgacaaacagggttttagctcacattcctgctccgtcaaggcccaaatgtcttagcgatgccgattttctaagcttctgaatgatagacactgttagtc

SEQ ID NO: 11067 - DNA, 325 bp, Homo sapiens
gggagagagagtgcagtcagactaggctgcagggtgaaggcaagacacccaacagacacgttaagagaaagggggccgggcacggtggctcacgcctgtaatcccagcactttgggacgccaaggcgggcggatcacgaggtcaggagatcgagaccatcctggctaacacggtgaaaccccgtctctactaaaaatacaaaaagaaattagccgggcatggtggcgggagcctgtggtcccagctactcgggaggctgaggcaggagaatggcgtgaacccgggaggcagagcttgcagtgagccgagatagcgccactgcact

SEQ ID NO: 11068 - DNA, 379 bp, Homo sapiens
cagcctgggcaacagagcaagaccctgtctcaaaaaaaaaattggaaaaaaatttaaacttttagatagcattcattcaagaaatatttatttagccactcacataatagcaagcagtaagctctaagatatagtgttaagtgtttggtgattttgctggactttgagattaatatcaagaaggttgaacataatcttccccaaattgcccttcctttttccctatcagagtcagaacctcgggctggagggaccttgggactatcccaagtgcaattctgatgttcttattggcttcagggtgcttgacttcaagatcaagcgaggcctggaagggcctgggccagggctttccttcagctcttgggcccccaaacac

SEQ ID NO: 11069 - DNA, 329 bp, Homo sapiens
tattaaaataattttctttttcattcctgatgttgtgcagtttactctgctgtgtctggatgtgagtttatttttttcctgctcaatgctagcaacacactttctttttttttattttgttttaatacttggatattttattccagcaatcctactttaatctcaataatcagctagagataatcatgttagcaacagtatcaaaatagtagtataaacgttgagcaataagagaatattgctcaatattatagaaaaaagggtaaaattttacataatcattagtctatgattttagacactatttaatgccataaaattcttttata

SEQ ID NO: 11070 - DNA, 478 bp, Homo sapiens
gtgacataaaaataataaccatttatttattattactttgtgggtcagtaatttgggctgagctcagatgggctgtcttctggtctcagatgatcttacttttgtgtcagtggtcagctactaatcagctaggtgactttgcttcttagggttgcctggctatcagctggagtgatgggagcaagcgggccatatttctttcatcatctagcaggctatcccaggcttgttgataagtcttgttgatatgtggcagtgcagggttgcaagagagagtagaagcatgcaaggcctcctcaggctttgactcagaaatggaacgatgtcacttctgccatatgctattggcaaggccagcccagattcaagaagtggagaaacagacatcactccttgatgggagactgagagacaaggtcacagagaaaaggagaattatgatacttgtaacacaccatgagcaagaatgaacaaagaa

SEQ ID NO: 11071 - DNA, 380 bp, Homo sapiens
gcgcccacgtgcggagtccccgggttaggaaaggccgcgcatccggaggccacgcagagcctcggggcttgcgcagaggggctgcggtgagtcctgaccctgagtgggggtcacggggctcgttgctcgctgaagtgaacacggttgcagctgtgcacagtggcggagggagaggatgagggactctgacccaaggttatgtggcagtgaggggcaagcagaaatgggggcctccggaccccaccccgagacagggctgctggccgctgcactatgctgaatatagcccaaattcttacatgggtcgtccccggggaatgctcatttttcaggctccagagcttgagagaaagtgcgaacccggtccctgagcaggtctg

SEQ ID NO: 11072 - DNA, 400 bp, Homo sapiens
aacacatggctttgttctctgtttattctctctgttctcttttctcctttaagagttgtgttgaaaatgggatctaattaaacctaagagcttctgtacagcaaaagaaactatcaacagagtacacagacaacctacagaatagaagaaaatattcacaaactatgcatctgacaaaggcctaatgttcacaatctataaggaacgtaaacaaatcaacaaggaaaaaacaaataaccccataaaaaagtgggcaaaggacatgaacaaacacttctcaaaagaagatgtataagtggtcaacaaagatatgaaaaaatgctcatcatagctaatcatcggagaaatgcaaatcaaaatggcaatgagatgctagctcacaccagtcagtatggctttc

SEQ ID NO: 11073 - DNA, 357 bp, Homo sapiens
tccagttctgcctctgcctagatttgaacctctcaagttatttgaggtcttatggtttgaatctctacgaagcctgggttccattagatggtcttctgagcccctttgttgactctcaaattgtgattctccaaaatgcccagaactctgttagccctatccaaaaatatatgtgtggccttgctacttaattgcaaccttggtgctggacagaagagaaaagcagcttcaaagactacatttctgaataagagagaagatcctgcactaatgaaagaaggcttgaggtatcctttgcctgaatctctttagactttaccccagagaataggcttggagtcagaactcccatcagca

SEQ ID NO: 11074 - DNA, 202 bp, Homo sapiens
tgcaaaagcagcggtaagaggaaagtttacagtactaaagtcctacatcaaatattataaagatctaaagttaatgacctaatatcacaccaagaaaaactagaaaaatgagaataaactatccccaaagctaaaagaagaaaaaaataactaaagatcagaagtgaatgacattgataacccaaaatccacacaaagaatc

SEQ ID NO: 11075 - DNA, 491 bp, Homo sapiens
caagataaaggcactgccactgcctaagagccaggtgctagtcttctaaaatggagctgtccatcagctgttttcaagagattttatttactaagaatgtccacagatagagagactatgtgagtgaaactcattaaagcaaatgctaacaaaatgaagccttgcctggcccagagaatgagccaaaatgcctagtggggtatctcccaggagcctgctgagagacgcattccttggactctgtgttagttgcattggagagcatcaattaaaattacgattatatgctcccgtcaaacttggccttttttcttcaatccaccagccactccaggccactccaggcccaagtttggagggactggaagcagatgtcacttactaggggaggagaaagggtgtttggtggagtgaggaagactgcagaagtaaatcgtgttcttcctcctttcccaaagctggcttccaataggcctaatttgccaagaaaa

SEQ ID NO: 11076 - DNA, 730 bp, Homo sapiens
gatgtaggcctgtagtcccagctacctgggagactgaggtgggaggatccctggagcctgagagattgaggctgcagtgagctgtcatcatgccactgcactccagcctgggtgacagagtgagagcctgtttaaaaaaatttttttttttcaagaaaatagatgaaaagatagagaattttgccagatgtataatcttccttcagagagtatccactctttcttctgccagacagattcagggctgcttgcctcagtccaatcagggattgaactgagtcaaggcaaagttgcagtcttggtaaagctaaatttatctttggttcacctctgcttgtaatctacgaccttctaaagctgagagtttgatgtttgtgccagggttcctcctcctggaaggttttgaactctaatctttgtttcctcagcacactgaatctgccagaactccactctgcttttcaggctttctggtgagcctcttagcctccttcccttcagagtttggcaaatatcttgagtggaaaatgagctgagtgttagattcagttttctgtatacaccctcctcaccaggatattgacttctgaattcttaagttttcttcttcccagctctatgaggccactaatagctctatcaatgttattggccctcatcccaggcaacactcagcttctcagctttttgccttcccagaatcagcaaatacattcagctaaaaaaaaaa

SEQ ID NO: 11077 - DNA, 452 bp, Homo sapiens
tatttcttttattttcaaagcctaggattgagccagtaacaaattgcctaacataaatcagcattatggaacttctgtctctctattctcaactctttttgccttatattataagaaaacgtaaaaggagtcagaagaaaagcagagagcttgcagaaatagcttgccactagcaacttaattcagcccccaaaataggaaattcacagctggttaaacatctgtgggccactggcggctgagaatgttcaaacacttaaactgtgttttccagatcaagccaatccagaagtctttaaatcaccataataaccagagaatagaacttccctggctggctgtgggctctttgggtacagttagctcgtaccctcagctgctcagagtggccccagggcctgctggactctcagggcctggtgctggcatctgtgtttccctcaggctcctct

SEQ ID NO: 11078 - DNA, 366 bp, Homo sapiens
gactttatcacttgccttttccttttgctttaaggtttaaaggatttgggtggggggagctgaagaaagaatattcatttctgtctttagtcatcatgttacaatttgcaaaccattttcacattctcactgtgaggtgagagagatacctttctccctggctttatagataaagaaactgaggctgggagatattgcctacctggtctaggcccagctagcaagtgatggagccagaacttggacccagatccactgactgcctattctgtgttttcgctatattactagcagttagggttctgtttcctgactaccagaatggaaagtttttctctcaccaaatttcagaagacaccttttttt

SEQ ID NO: 11079 - DNA, 890 bp, Homo sapiens
ctaagtgtctgtaacattatgctaaatgaaataaaccagacaccagaggtaagaactgtatgattccatttatgtggaatataaatataaatatagcataatgttttcaaggttcattcattttgtagcatgtatcagtacttcattcctttttatggccgggtaatattccattgaatgtatataccacagtttatccattcattggctgatggacacatgggttattttcacctcttgagtattgtgaacagtgctgctgtgaacaaacatgtgcaagtaagtatttgtttgaatacctattttcagttttttgggggtatatatctagaagtagaattgctgggtcatacagaaatactgtgttaaactttttgagaaacctcaaaattgttttccacagcagccacaccattttacattttcaccaccaatgtacaaggcttcaacttctccacatcctcaccaacacttagttttcacttttttgattattgccatcctagtgagtgtgaattggtatctcattgtgattttgatttgcgtttccctaatgactaatgttgttgagcaactcttcatgtgcctgtggccatttgtatattttctttgcagaaatgtctacttaagtcttttgaccactttaaattggattctttgtcttttctgttgagtcaaacaagttttttatgtattctggatgctagactcttatgagataatgtgatttgcaaatattttctctcagtattgttcaatttgctcttatttttgttgttggtgagttgaaagttgagtcattgatttgagattttttttcttttccaatatgggcaataccttctaagtcctagtttagtgcactccacaacgttcgatatgttattttc

SEQ ID NO: 11080 - DNA, 326 bp, Homo sapiens
acgctgagtgctggactctgtttccacgcgaggccttggggtggaggggtgtctcaagggagtggccaaggcagaggaccctctttctggatgtcctcacttgcccatgggaagggaggtggtcctggctgagccacaaggccctgcaggcccaggccctgcacacatgcaccttggcagagccagccagagaggcctgatgaccagagcacccaagcggcaagggcaggcaggagtgcccaggagggagccaagctgtggccgctctgctgagccatccgttccagcaggcagcaggcagcggactgagaatgctcagttcagaa

SEQ ID NO: 11081 - DNA, 230 bp, Homo sapiens
cctgctgtcttttcttttctgttcttttctttcttttttcttttcttttgagatagggtcttgctctgttgtctagcctggagtgcagtggtatgatcacagcctatttcccaggctcaagtgatcctcccacctcagcctccaaagcagctgggatcacaggcagtgccaccatgctcagttaatttattttttgtagagatagcatctatttgcccaggctggtctca

SEQ ID NO: 11082 - DNA, 311 bp, Homo sapiens
aacgccccacctactagtgtgtgctcggtggaaatgtcttgtgactgtgcttaaaatgaagggcatgattgggaggccaaggtgggcggatcacaatgtcaggagttcgagaccagcatggctgacatagtgaaaccccatctctactaaaaatacaaaaaattagctgggtgtggtggtatgcacatgtaatcccagctactcgggaggctgaggcaggagaatcgcttgaacccgggaggcagaggttgcagtgagccgagatcacgccattgcactccagcccaggagacagtgcaagactccatctc

SEQ ID NO: 11083 - DNA, 424 bp, Homo sapiens
atctgaagggataatggctacttgaattacttactgaagcataaggaaaaggaaaagctgatctgtgttcatgttatttttgtatgactaaaagtaactaatattgctgacaaaagggtatgtgaattttatatgactaaaggttattaggagctgatcattgctttgagtttagtgtcttagatataattttaatatgaaatatcaattttattttccacatttttttccaggctggggtgtagtggtgtgatcttggctcacgcaacctctgcctcctgggtttaagtgattctccagcctcagctactcaagaggctgaggcatgacaatcgcttgaaccagggacacagaggttgcagtgagccgagatcacgccactgcagtccagcctggcgacagagcaagacttcatcatgtgaaa

SEQ ID NO: 11084 - DNA, 308 bp, Homo sapiens
acaggccaagtagagaccccatttgcatagtaaaagattagggtggagtggccagcttcttcacgtgctatgtaaacatcacacctggtccaaccaatcttcgggccctatgtatatcagacaccatttcttcaagcctgtctataaaaccctgtgcactctactgcaggctggaagtctctcttgtaggagagggagctgttctcctttctctttcttttgcctattaaacctctgctcttaacctcactccatgtgtgtccgtgtccttgatttccttggcatgagacaacgaacctcaggaattt

SEQ ID NO: 11085 - DNA, 1634 bp, Homo sapiens
tctctactatgatgtttgactgacaacagcaatgtgggtctgtattgccctatgttctaagtcctggggtcatatatttgcttaaaaaaactgttctagtggctggggactagtgtgctttctaatttttttgatgtgaggttgatattgtgataatcttatgtcttcttgaccctttggactctttaatatgtatgacatgcaattgtggggttagattaattcaactcctgaggtcctgaaggaacttcacccagtcaagaggaagacagccaaggctgcagctgctgaaggaaccccatatctgggcagacatctttgtgagatctatatggctgaaatgagaaaaacgagaaattgggaaaggcagaattttggactttaattattttggactttgaattaggaaatttaattttgggcagtcctttttcccttggagtttaatagttgatggggtgggggtgaggtcatatagttcaaactaaggcatttttattatgttgttgatattgtattatttggagtattttaatgctatctttgggagtcattgtataattgttgtcagctatgtcaggaaatatggctggacataattgtaaattagggctgcaattgtgatcaaattttcagtctagggtgtaatgtagccttagagttaatttaattactgttctattttgacttatttcagagcctcttgggggcaaaaacaactgctcaccaatcttacattgatgggagcagaacttttctaagatactgttggtctccctggaaggggacagccacagccctgtttgttgaccagagtcttgagcattaaccattgtggcttaagagaatgaaaatgtacaagggtatgatgggatctatcctcttcctctctccatgctcctgactcaagaaaaggaaaagacttgcatctctcaaaaatgtttggaagaaagttctacccatcttctcttacactcattcaatcttatgcttgggaggaggaataacttgatgagattgagaaaatggttataatggataggcagcttaggccactcttggatcttgagttcgttccacacagcaagatgtgggaaagactgcagtccttcactacatggctgggtaaacatctgctttctagacccaactatctctccttggggtgggggaatcccaaagtcgttagacttatgatagaagttcatttcagcctcaggtccaagccatgttctccaatccagctctatcagctataaagctggtatctattttgattcttttttacagttttaatatataaattgttttttagaaaaataacacatgcctatggtaaaagtcaaacagtataaaagggtatactattaaaaagtaagtctctcttcctccttctcacccctggcctcagttccctggtcccattttcaaaaagtaacaactgttaccagttactgatgtatcattccagagatattccatgtatttacaagcatattgtgtgtgggtatgtgtgtatcaggtttttttttttttttacacaaatggtggcatactatacatgctgttctgaattttgcttttttcactgaacaatatattaaagctgatatcttaatccctaaatgattcct

SEQ ID NO: 11086 - DNA, 534 bp, Homo sapiens
tctctactatgatgtttgactgacaacagcaatgtgggtctgtattgccctatgttctaagtcctggggtcatatatttgcttaaaaaaactgttctagtggctggggactagtgtgctttctaatttttttgatgtgaggttgatattgtgataatcttatgtcttcttgaccctttggactctttaatatgtatgacatgcaattgtggggttagattaattcaactcctgaggtcctgaaggaacttcacccagtcaagaggaagacagccaaggctgcagctgctgaaggaaccccatatctgggcagacatctttgtgagatctatatggctgaaatgagaaaaacgagaaattgggaaaagcgctgtaggtttacctacagcgccttcatcaaacacatcaccactaccattccaacactatcaccatctacaccaccatcattgcccatcactatcaccccccctacttacatcatcacccccatccacaccaccatcacccacattcaccattcacaattcacact

SEQ ID NO: 11087 - DNA, 587 bp, Homo sapiens
atacttgatactgacagaaactcaacaaccctcacataataaaacttaggagtatgatttttcaggacatctgaactcagtgtatgtcagaaaagtcacataggacaaatctcggacagcatcctgaatgaccatggcttttatccccaaagtcttcctcatcagacaggtaatatcataagaaatctgacattttaacaaatataggaaattcttcacacacacagacacacactcacacatacacacccaaagtctcattaaatatatgataatttagttttgaatgtgtaaaagttttcaacaaattatcatattttatatcagagcttgttacaaggagaaaatctatcaatttgagaaaggtaagtaatagcctttatctagatattgctttatcagaactgttgtttcacatataatatcaaaacttttaatgaaatataagacattcactataataaaaagcttaaaaagaacaaaaaataaactgcataaactgaaaagcagtgttgcaaatatgtgaatgttttgtgagttattgattgtttatgtatgtatatatgcatggtacttaccaggtattt

SEQ ID NO: 11088 - DNA, 405 bp, Homo sapiens
tcttgagactaccattactttattgtgttaggtcagagatacaaaaacagacagatgcacacatagacatgcctccaaatgcttcaaaatctattctacaaatagcattagctccatttttcttctaattttactctcatacaaagattcctttcctgagctgcctacttcccattttctacatttccttaatccactcctttctctacttagtattttaccttcttgaaacttgcagctcttcaaaattatgtaatctcccaaaggccaaaagcttcatttcagtctagtatacatgtttcttcaaatcgataatattttatttatagtacaaataattttaatattttctcagtaaaccaaatatattgtggaaaatgtcaaaagtttaaaaataatgcctaa

SEQ ID NO: 11089 - DNA, 464 bp, Homo sapiens
gggggtgtggttggctctgagagccccgggaaggaactgactgggaggccggttgtgctccgggctcaccttgccccaggagtgccgtccgtctgtccaggggccacataggggcccatgcgggctctgccagcagctgcagggcgtttcggagatggcctcggagaagcccctgggcggagagggacggacttaggcttggcctcttgtgaccagctttttgatgtagtacttgatggaaaacagcttacttagctttcaaaattttgaattcatagatccagggctccagcttggtcaacgagctcctgcgaaacagttgcagagatattattttgtaactccttctcaaaatagaaatatgactgagtggttgagaagataaatgcagtaattagggctttccagagatttgtctgaggcattgttcaattggggcttgaaattcttttttttggttcaca

SEQ ID NO: 11090 - DNA, 901 bp, Homo sapiens
ggcctctcgagagtgcaggcgccgtggggcgtcagctggacaaaagccgacccgacttcatttgtctgcctcgaccccgaccccggctggtagacagcactcctgatgcacgggacgagggagcggcacgagcaaaggccctgaaacaggagggagcgcgggccatccatcagtgctggtgagctgagctcagctgacaagccagcctggcacggagcgctgcccctcctgctggtcccagatccgttctgtccggaggagaatttcttatccccaggagatgcctggcctcgttaggagcctcctcacccgcccgcccgcaccaaccctctgactccctccacctcaccgcctgggaacaacaggaagagagcaggacagcagcagaaaggagtgctgcttatgtggctcttctcagaatcaggaggctcccaggccaggaatgtgaaaccattatgcagatgaagaagatgaagcccgagaggttatgaaacagacccaagtgggctcgctcttcagtctcggcataaggaatccggaacctgggcccgtgtccggaactgctgtgcccaggcagcttgcctggaaatcaggtagcgtggggggaccccaaaatccccctgtgacagaccacgaatctgccgtgtttgtgcacctctgttttgcttcccagaaacgaaactttggcaactggagagggatggagtggggcgggtggggtacagcaagatcgggaaacagcaccgtcctcaaatgcctgcagaaggtgagagaaccagcaagtgtgatgaagcacctgtgtgcttcgcagccattaccgtgtctaaatctcacaaccacacagtgaggaagggtttctgtttccattttatagataagcaaactgaggctcagagaaagt

SEQ ID NO: 11091 - DNA, 1089 bp, Homo sapiens
ggcctctcgagagtgcaggcgccgtggggcgtcagctggacaaaagccgacccgacttcatttgtctgcctcgaccccgaccccggctggtagacagcactcctgatgcacgggacgagggagcggcacgagcaaaggccctgaaacaggagggagcgcggggtacctgagtgagattcatcgtagatgcctggatgaagagaggggccttgcgcttctatttgccttgttacatagtgtttcttggaaaggctgtccttccctactccaagcccctcccctcactccccacccaggatctgggcactggaggcgccagacatcttatgccctgtccaaggctagcagggccatccatcagtgctggtgagctgagctcagctgacaagccagcctggcacggagcgctgcccctcctgctggtcccagatccgttctgtccggaggagaatttcttatccccaggagatgcctggcctcgttaggagcctcctcacccgcccgcccgcaccaaccctctgactccctccacctcaccgcctgggaacaacaggaagagagcaggacagcagcagaaaggagtgctgcttatgtggctcttctcagaatcaggaggctcccaggccaggaatgtgaaaccattatgcagatgaagaagatgaagcccgagaggttatgaaacagacccaagtgggctcgctcttcagtctcggcataaggaatccggaacctgggcccgtgtccggaactgctgtgcccaggcagcttgcctggaaatcaggtagcgtggggggaccccaaaatccccctgtgacagaccacgaatctgccgtgtttgtgcacctctgttttgcttcccagaaacgaaactttggcaactggagagggatggagtggggcgggtggggtacagcaagatcgggaaacagcaccgtcctcaaatgcctgcagaaggtgagagaaccagcaagtgtgatgaagcacctgtgtgcttcgcagccattaccgtgtctaaatctcacaaccacacagtgaggaagggtttctgtttccattttatagataagcaaactgaggctcagagaaagt

SEQ ID NO: 11092 - DNA, 1400 bp, Homo sapiens
ggcctctcgagagtgcaggcgccgtggggcgtcagctggacaaaagccgacccgacttcatttgtctgcctcgaccccgaccccggctggtagacagcactcctgatgcacgggacgagggagcggcacgagcaaaggccctgaaacaggagggagcgcggggtacctgagtgagattcatcgtagatgcctggatgaagagaggggccttgcgcttctatttgccttgttacatagtgtttcttggaaaggctgtccttccctactccaagcccctcccctcactccccacccaggatctgggcactggaggcgccagacatcttatgccctgtccaaggctagcaggtccttgtccctgaagggccatggagctaagtgaccagcgtgcctctctgggtcccgtgtgtgtggtaggaatcttcacactgccttgctgtgaccgtgggccatcgcatcacctccctgtgccttggtttcctggcctctaaagactgaccttaaggggttgtttgtaaggatgaaggcacaaatgcaagccaagtccttagaattctcagcacatagcaagtgctcaatgaaccgcctggctgctgttcgctggggacacagtcttttgctctctggatgtctgaccgtgccctgtccctgcctcacagggccatccatcagtgctggtgagctgagctcagctgacaagccagcctggcacggagcgctgcccctcctgctggtcccagatccgttctgtccggaggagaatttcttatccccaggagatgcctggcctcgttaggagcctcctcacccgcccgcccgcaccaaccctctgactccctccacctcaccgcctgggaacaacaggaagagagcaggacagcagcagaaaggagtgctgcttatgtggctcttctcagaatcaggaggctcccaggccaggaatgtgaaaccattatgcagatgaagaagatgaagcccgagaggttatgaaacagacccaagtgggctcgctcttcagtctcggcataaggaatccggaacctgggcccgtgtccggaactgctgtgcccaggcagcttgcctggaaatcaggtagcgtggggggaccccaaaatccccctgtgacagaccacgaatctgccgtgtttgtgcacctctgttttgcttcccagaaacgaaactttggcaactggagagggatggagtggggcgggtggggtacagcaagatcgggaaacagcaccgtcctcaaatgcctgcagaaggtgagagaaccagcaagtgtgatgaagcacctgtgtgcttcgcagccattaccgtgtctaaatctcacaaccacacagtgaggaagggtttctgtttccattttatagataagcaaactgaggctcagagaaagt

SEQ ID NO: 11093 - DNA, 438 bp, Homo sapiens
gtctgcctcgaccccgaccccggctggtagacagcactcctgatgcacgggacgagggagcggcacgagcaaaggccctgaaacaggagggagcgcggtgagtgccttgcccagatccctgggccgtcgtgggacttgggccttctgtgcgctgcggggagccgtgcagggctgcggcgtgggatgccggactcgccctgggtgtcgggggaaggagatgggggaggttgtactggggccatacagtcattgtagaacctgttccccccgagggccgtctgtcgggtcccagagccaggaccacggttgggacaatttgagcgcccacctgagcaccgttgtccctgtgcgaatgtgctttggtgaaaactgtgcctccttctctagaggaaactagataccccctacccgcaaatcaggccaagcccaccatgttat

SEQ ID NO: 11094 - DNA, 301 bp, Homo sapiens
aaaaagcttctacatcaggtatacaaacaaaaagccgagagcaatggatcacgtctgaaatcccaacactttgggaggctgaagcggtaggatcgcttgagctcagttcaagaccagcccgggccacatagcaagaccctgtctctacgaaaaaatttaaaaaattagcctggcatagtggtgcatgcctgtagtcccagctacttgggagggtggagcaggaggactacttcagtccatagtttgaggatacagtgagcttattcaagccactgcactccagcatgggcaatggagtgaa

SEQ ID NO: 11095 - DNA, 531 bp, Homo sapiens
tctttcctgtgtttgtctgttacagtttatacttctggtttatcattcttttcttcatattagtatttcttattgtgatagaaaatgcttcccagtatccattcttacattcatcctcagtgttacaatttctaaagttttaggtgtccattttctgattattgttgcagctaggaatagctttgtggctaagttttgtcaaagggaaagaagtagaattggtgtgtgaaagatccagaaaatgtgtgcctttttcttaaaaaggaaggaagtgtgccctcctccccacactcccattttattttatttttgctgccattcaggctgacacaggagtaaacatgccaggctatgagaagggagcctgtgatcttaattattacagaactcccatacttgtgttaaacttcgtatacttatgagaaggtaatacatttcaatcttatttgatcctctgttcttttgggctttgtcatttgcactaaaatctaatcctaacaaataaacacttgtaatatctttcccgctaaa

SEQ ID NO: 11096 - DNA, 369 bp, Homo sapiens
ccaagaacttaaaataagcctaataaacatactaaaagagataagggaagatattagcggcatataataagaacaagagaacaaagaagcacgcagaaatattaggtacaaaaatataatacttgaagtatatagactggataaataatagaatttaaatgaggagtaaattaatgaatccaaagatcagtttgaggaaatcttcaaacctaagaacaaggatatagaaaatataaaagaaaggctaagggattgacagtgctaacatctgaataacaggagactcagaaagaaaaataggctgggtctggtggctcacacctacaatcccagcactgtgggaagccaaggcgggaggaccacttgagg

SEQ ID NO: 11097 - DNA, 195 bp, Homo sapiens
atcatccttcttactggaatgatatgccattatggttttaaatactaatacatgttaaggactctcaaattgatgtcttaagccctgacccaaattcctactcaaaatttcatcttaagtgtctaatgagcatcacaatattccattactcttcctttactctcaatggaagagactggtgaacttttttcccag

SEQ ID NO: 11098 - DNA, 429 bp, Homo sapiens
tataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgaagatcagggtcctagagtaacttaatattttgtacattggttatttgactcctcatttttatattacatgttatatcaagggagggggcataaaagaaatacaaaaattgcagaggtatctggaatgtacctatttgttaattctatttgtcatttcttttgtttcatcttttgagtaataagctgcttggaaaagtttctgt

SEQ ID NO: 11099 - DNA, 421 bp, Homo sapiens
gaactatttgtgattttccaaagaatatctatatctattttctcagaattcataatttcctagtttttctatctacttcactgatactaagctaagaaagtgacttactatccaattgtccacccacacaataattgtgtggtctaataattctaggccatattttctcaatttaatgaaagtatgtcttagttaaagtcttgtttgtagtaaggctagtccacagcaaataaaacccattgtcatctaagtctagtcatggcatgtcttttttataggtggttccacataagtgacttttccaggtaaccgaagcttataattcagatgcccaaatgattttcattttaattacattgattagaaattatttaaaataataactcccttttttttgctttcttaagcatagtatctcaaa

SEQ ID NO: 11100 - DNA, 478 bp, Homo sapiens
ataataataataataatagcaataataaacaacaacaacaaaaaaaccaactaggggatggggaaaaggtataaagagaacaacaattcaatgtcgtcctcaacaagcacttctcaggtttagaatattgtatactcagtaggcctttaataatttgctatgtccagcctggactgcatcatttggaaaggtaggagacaaccttgaacccttgctgcctttctcccatattgaatttaacctgtgtcatattcctgtaaactgcccagctcatttcatatcactgtatcaaccataaagcaaacacgaacaggcgtatctgagctgaaaagtaaacagttatcaggtgacttctcgtgccatgtggagctgtctgaggaatagcaataaatgtgaaaccttgccccatggggacttaatggtgttagacaatcttgtgacagaaaccataattcctctggttgctgtggcaattgac

SEQ ID NO: 11101 - DNA, 901 bp, Homo sapiens
tgttcatatagttccatgtgcctttttacttaactgcactgataggcaatgtaatgaagaagtttccttttaaaacgtaaaatgtaattaaacagagtttatcttaaattggctggacccgcacagcttgactgagacatacacagctgtcttcattttgaagcacctacactagtcaagcttctttctaacccgcccttagggtttgcctgttggtctgtcttccctactgggctgttaatcccttggaggcagattgtcttgtttcccagagtttttccagcatataccatggcagacaattttcaccttatctattctaactcgtaagcctcagctagtgcctccatcctcgggtgcatagcccagtgacaggcatgtaacagactttgcctacaagcagttgctgatccataaatgacgttggcaaccttcttgtggcagtgagtaacatatttctttcctcctgataggcttggaatcctcatccccatctggcaattttctttccatctttcctacactcacaatggagcccacacgcctcacaacccccttgactaaaccagatgacagcaagaatgcctagttccaagtgagcaagggtgaagccttaggcccttgtctcctccagacctcctctctgctctaagagtatactgggcatggggtgtggtcggggggttgggggcggaggagtacttaacctcaaactgagaaaaagggtgtcctgagcaagtttcatagcgtagcagcttccatttgaaatgtgaagctttgaaggcctgttgctacagtaaccagctagctcctgactccaatgcctgtctaatctaaggtggaaatgtcccagaaacagaccccaggctggcagctcttaactatgacccatctcataagc

SEQ ID NO: 11102 - DNA, 1491 bp, Homo sapiens
gaagcccttgtttgtgaacagtgattgtttcccggatgacagccagatgccgggcagggccacgcagatcttagctggagcctacaggtacaagtgagagccaccccctttgacgtaactggactggcatttacggaactcatgtacagcccactctcaggaacaccagccaggaaccgtgacatggaggagaggaattgggaggaaccgaggggtcatcaaaggctggtagggcttaggtgctctagcaaacatcctagtctgtggggttccagagctctggtgctacagctcccaaccctttgattggcccaggaactggctgttgagtgggcatccgtgttcatagctctgccccttgcaaccctaaagcagataaaatgcaggaggcagaaattgctggcagacagcatccaattaatccccactacccaattcagtttcttcccctgacctgacacgtccctgcccagctgtgcctcccactgttcaccttttgaggcacaaaacgggctgtttatgctgctgctgcatttagctcaaaacagggcttcagagtcaaggttctggactcaggcacccggattaaatcctgccctatgaattcctagccaggtgacctcaggcctacataacctttctgtacctcaacttcctcatccagaaaacagggatgatgctgtctacctcattggatggttgtgcaggatcaaagattcagtcattcagcaaacctataccgagtacctactgtacattcatgagtgctaggcagccagccttccaggtgctcaggtacatctgtgaacacaactggctattggaggaagcaaaatcagtaacatgacctgctctctttgatctgtgctacagaaaaaaaggaaagtggagaggcatcaggaagtcaggagtgctggggaggggctggtaacagtcatggtattaaagaggagggcaggcaggccttactgtgaaggtggtatttgagatgaagtagttggtcagagtccctgtttgacacatggagaccaccttgacagcaaaggccctaagggggagcggtgcaaagcaaggtgggctggtgagtgagaggagagggatggcatagagctgggtgggggcacaggagcccgtggggaaggtgttcgcctctgaatgaagtggggttgtatcagataccacgggtgaagcatcgggaagaggatcctgcctgtaaaccctgctcaaggactgcaccatcatcatgcccagtgtgtgcgtgtattaggtttgtatgaatataatgttgccaattgtatctgtttttatgaaatgtttgctatgtgccaatgattattcgatccatggggagaccatagaagaatgatccaaggagttgggaggggaatcaaataataaatcagcgattctgcaatataacgccattggtgatcggtgtcatgaaagaaatacaacatggtggggaagagtgtgctggggatgttcaggtag

SEQ ID NO: 11103 - DNA, 430 bp, Homo sapiens
cttcgccatctgctctgcaccgaaattggattctcctacgcagaggagaaggtggagaagattctccgtcttccggagggtagctactgccggtagctccgatttccttcggatcccctttcaagggcaagcagaaggaaatcagttctccaaagaaagtggcccggctgagtaagtgggaacaaggtggttggactgaggcacgggatcttttagctccgttgctcttctaatcccgtggccttgggcaccgccacttcatcctctgaactgctggaataatcacttctgactagcagagttactgggagccgctgtttgtcagtgttcacattctgactttagcaggagatggagcgagcgaaggagtgaagcccttgtttgtgaacagtgattgtttcccggatgacagccagatgccgggcagggc

SEQ ID NO: 11104 - DNA, 1140 bp, Homo sapiens
ccagttcgagcttcctggctgctttgtttacctaatcaagcctgggcaatggcgggcgcccctcccccagcctcgctgccgccttgcagtttgatctcagactgctgtgctagcaatcagcgagactccgtgggcgtaggaccctccgagccaggtgcgggatatattctcgtggtgcgccgttttttaagcccgtcggaaaggcgcagtatttgggtaggagtgacccgattttccaggtgccgtccgtcacccctttctttgactcagaaagggaactccctgaccccttgcgcttcccaagtgaggcaatgcctcgccctgcttcggctcgcgcatggtgctcgctcccactgacctgcgcccactgtctggcactccctagtgagatgaacccggtacctcagctggaaatgcagaaatcacccgtcttctgcgtcgctcacgctgggagctgtagaccggagctgtagacaggagctgttcctattcgggcatcttggctcctccttgacaagcttgaaggtgagcacctcgaagggcttctttttatgttgaaaggcacgggtttgcatggcggttcatcagaggtcaataccccagtttgagaaagtccactgtggggaggaaagagagacttaaacaagccctggaaaaacaaagaatggaacacccctccgctgacttcaaccaactgcctgctgatgcggcctgactcccagccctttttgcagttttgaagtgacaaactgactaggctacaaagtattcaaccatgggctggttctggctggttcaccgaggctgtgtacaaagtgtcttcatgtcctgtgtttcaccttttaacatacagaacctaattttactgcattttaatgttaattctccactcgaaggtgaacatgggatgtatgtaacacatatgtttgcttatcaagcacacatatgaccccctttcatgaatattcatagttccccctgtgacctgttgaatatgtctgtttagccaacctgtttggcataaaactcctatcccaccctatctccctcaaagtacctgtttgtggtctcagctggaggtgccacttcccagcctgcagtttgcaacccttctcaagaaataaagtcttcctttccaag

SEQ ID NO: 11105 - DNA, 717 bp, Homo sapiens
gacagagcgagactccgtctcagaaaaataaacaaacaaataaataataaaaccctgagccctctgactgactgaacagacccctcttggccaaggtgacccccaaaaaactaaaaactaagtttcccggccgtaaggagatgggaaattgcgcctccgtataccccttcctcactgttaccagggtttttttttgtttgtttcccaaattaaacagaaacaagccctggaaaaacaaagaatggaacacccctccgctgacttcaaccaactgcctgctgatgcggcctgactcccagccctttttgcagttttgaagtgacaaactgactaggctacaaagtattcaaccatgggctggttctggctggttcaccgaggctgtgtacaaagtgtcttcatgtcctgtgtttcaccttttaacatacagaacctaattttactgcattttaatgttaattctccactcgaaggtgaacatgggatgtatgtaacacatatgtttgcttatcaagcacacatatgaccccctttcatgaatattcatagttccccctgtgacctgttgaatatgtctgtttagccaacctgtttggcataaaactcctatcccaccctatctccctcaaagtacctgtttgtggtctcagctggaggtgccacttcccagcctgcagtttgcaacccttctcaagaaataaagtcttcctttccaag

SEQ ID NO: 11106 - DNA, 1014 bp, Homo sapiens
ccagttcgagcttcctggctgctttgtttacctaatcaagcctgggcaatggcgggcgcccctcccccagcctcgctgccgccttgcagtttgatctcagactgctgtgctagcaatcagcgagactccgtgggcgtaggaccctccgagccaggtgcgggatatattctcgtggtgcgccgttttttaagcccgtcggaaaggcgcagtatttgggtaggagtgacccgattttccaggtgccgtccgtcacccctttctttgactcagaaagggaactccctgaccccttgcgcttcccaagtgaggcaatgcctcgccctgcttcggctcgcgcatggtgctcgctcccactgacctgcgcccactgtctggcactccctagtgagatgaacccggtacctcagctggaaatgcagaaatcacccgtcttctgcgtcgctcacgctgggagctgtagaccggagctgtagacaggagctgttcctattcgggcatcttggctcctccttgaaaacaagccctggaaaaacaaagaatggaacacccctccgctgacttcaaccaactgcctgctgatgcggcctgactcccagccctttttgcagttttgaagtgacaaactgactaggctacaaagtattcaaccatgggctggttctggctggttcaccgaggctgtgtacaaagtgtcttcatgtcctgtgtttcaccttttaacatacagaacctaattttactgcattttaatgttaattctccactcgaaggtgaacatgggatgtatgtaacacatatgtttgcttatcaagcacacatatgaccccctttcatgaatattcatagttccccctgtgacctgttgaatatgtctgtttagccaacctgtttggcataaaactcctatcccaccctatctccctcaaagtacctgtttgtggtctcagctggaggtgccacttcccagcctgcagtttgcaacccttctcaagaaataaagtcttcctttccaag

SEQ ID NO: 11107 - DNA, 796 bp, Homo sapiens
ccagttcgagcttcctggctgctttgtttacctaatcaagcctgggcaatggcgggcgcccctcccccagcctcgctgccgccttgcagtttgatctcagactgctgtgctagcaatcagcgagactccgtgggcgtaggaccctccgagccaggtgcgggatatattctcgtggtgcgccgttttttaagcccgtcggaaaggcgcagtatttgggtaggagtgacccgattttccaggtgccgtccgtcacccctttctttgactcagaaagggaactccctgaccccttgcgcttcccaagtgaggcaatgcctcgccctgcttcggctcgcgcatggtgctcgctcccactgacctgcgcccactgtctggcactccctagtgagatgaacccggtacctcagctggaaatgcagaaatcacccgtcttctgcgtcgctcacgctgggagctgtagaccggagctgtagacaggagctgttcctattcgggcatcttggctcctccttgacaagcttgaaggtgagcacctcgaagggcttctttttatgttgaaaggcacgggtttgcatggcggttcatcagaggtcaataccccagtttgagaaagtccactgtggggaggaaagagagacttgtaagtaccaactgtgctccactctggttttgtctgtaagcctggaagactcaagctctgggacactttccttctagtcttgggactggtagcacctccagcaactcccaccccgctgcgggcaagctgttccttttcttttaacctatttgtctc

SEQ ID NO: 11108 - DNA, 383 bp, Homo sapiens
tatggcatactaacatttatctttggaagacagaaaaaaaaagaatttgacatttgtctttaaaaaaatatttatgtaacaagactctgacatttgcaaatggctccttatttgcaactaagtctggcctctatgagtgacagaagtgactggaaattttcagaattattaaatggatctcacagttcattgttaaggagatagcttggtggtatggaaagaacaaaagctttgaagccactcagatgattaaaaaaaaatggggggaagatatggtgcctcacacctgtaatcccagcacttcgtgaggctgaggtgggaggatcacttgagcccaggagtttgacaccagcctgggcaatatattgagaccctgtctgtat

SEQ ID NO: 11109 - DNA, 439 bp, Homo sapiens
gtagagcctgaaagtaggaccgaattgctgcaatctaatgattaaacttgaatggatgactagtggcttcttatggatgaacaaataaagtcatttcttttgatagaatctagaatctactcctggtgaagattccgttaacattatttaaatgacaacaaaggatttagggttttacataaacttagttgataaagcagtggcaggatttgagaggattgactccaattttgaaagacactctactgtgggtaaaatgccatcaaaaagcatcacatgctacagagaaatctttcatgaagagtcaaccgatgcagcaaacatcattgttgtcttatgttaagaaattggttgtgaggcacggtggctcactcctgtaactctagcaggttgggaggccaaggcgggcgaatcacttgaggctaggagttcgagacca

SEQ ID NO: 11110 - DNA, 836 bp, Homo sapiens
tcacattcagcatagggaaaactgaagggtgccaggctcggggacttcttccaacagagtggctcttccccaaatatgaaagaaaatcatcaaattaaattgaaggcaaaactaagcttccaccacaaagacatagcagatagttgcaaggtggattccttcgggccttttcctttcctaaggctaaaacaatgctaagacaaaagtcttcttgcagctgtctccgcccctccgagataaatactttcccaattctcccccaccctgtacacacacccacgcccgcggcagctggatttctgtcttctgcaatagctcgatttaaatgctttgcttttactctttattatcactattatttgtgtgaagccctctcgcctgctcctggtcaccagcaggagcctgcttccctccctccttccccccaagcctctgggcagcagaagctagctgggagctctgtgcagctggcggcgacgccatgtgactgtgagccgagcaccatcacccagagtcactctctagctttcccctaatacacttcacacccacgcactgtggaggtgcgagagaggttgctccgtgcggtgctattcgaggcagatgcagagagcgccctggagtaagctctccaatcctagagctgcgcgggaccctgactgaaggcggagggggcgggagggggtgctgttgctatatttagactccctatggagtttctgtgcagggactttcagggtgaaagatctagagacttaaaatgactcgtgtgcccgctttaaacgtcaaaatcttggcctttctgcaagcagtaaaatgaaaaccacttcctctta

SEQ ID NO: 11111 - DNA, 1090 bp, Homo sapiens
cgaaagggttgtagacatggcggccatcaggatgggaaaactgacaaccatgcctgcaggtctgatatatgcatctgtaagtgtacatgcagccaaacaagaggaatccaaaaagcagctagtgaaaccagagcagctccccatatatactgcaccaccgctccagtctaaatatgttgaagagcagcctggtcatttacaaatgggctttgcttccatccgcactgcaactggttgttacattggctggtgcaagggtgtttatgtctttgtgaaaaatgggataatggatacagtacaatttggaaaagatgcttatgtctatctgaagaatcctcctcgagattttcttccgaaaatgggagttattacagtttcaggattggcgggcttggtttcagcgagaaaaggttccaagtttaagaaaattacttatcctctgggactggccactttaggagcaactgtttgctacccagttcagtccgtaataattgctaaggtaacagcaaaaaaggtatatgctacaagccagcaaatttttggagcagttaaatcattgtggacaaaaagcagcaaagaagagtcactccctaaacctaaagaaaaaactaagctaggatcctcttccgaaatagaagtacctgcaaaaacaactcacgtcttgaaacactcagtgcccttgccaacagaactcagctctgaagcaaagaccaaatcagaatccacttcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatgacctttaagggcactta

SEQ ID NO: 11112 - DNA, 468 bp, Homo sapiens
agagaacacacatgcgtgtgcagtgtagtaaacctcatgtgcagtggctgattacctttggagacagagcagatgaccataagcctcatctgggtaagaacagctcaatttagccatcatacccaggctttaccagcccaggaccccaaagcctacattattctgattggtagcatagcagcatttcttcatatctgccttcctagtatggatacaactttaggaaatggtcctactagactagacagaaatttgactcaaaatggttgaggccatgccaacctgaatagaagtgccagcacatggcttctgtgttatctgttatctcactgctttgagaagcataaagcctcatccaaaacaatgatgtgagggaaagcttacaaagaacactgtggaatggcccttttcatatatgagaaaatatttgaaaacacgtacaatacattaatactatgaaaaaaagaa

SEQ ID NO: 11113 - DNA, 4503 bp, Homo sapiens
gaaaggaagggagaagggagagagagagagagagagagagagagagagagagagagagagagagagagagagagagagagagactcacagagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaaaaaaa

SEQ ID NO: 11114 - DNA, 932 bp, Homo sapiens
  misc_feature (19)..(19): n is a, c, g, or t
atcgggctagtagaggccngtggtgaatcggccgaggggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgcagtgaagatgggagggccgggtcgcaaacgggccggaccgccctgctcccgcgagaccatgggctccggccaggcccg

SEQ ID NO: 11115 - DNA, 4646 bp, Homo sapiens
gaggcaggcttggttcccgcttggttccccctgcactgggaagctgccgccccgcttcccttgctcacacagggctttgcagtagtggtggcagccgcggcagaaactggctctggggaagcaattgattcgtctactgccagcagcccggagttgcctacgcggactggaaaggagagagagagagagagagagagagagagagagagagagagagagagagagactcacagagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaaaaaaa

SEQ ID NO: 11116 - DNA, 4885 bp, Homo sapiens
gaggcaggcttggttcccgcttggttccccctgcactgggaagctgccgccccgcttcccttgctcacacagggctttgcagtagtggtggcagccgcggcagaaactggctctggggaagcaattgattcgtctactgccagcagcccggagttgcctacgcggactggaaaggagagagagagagagagagagagagagagagagagagagagagagagagagactcacagagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaaaaaaaaaaaaaaaaagggggggggctaaaagttacccggaggcccagttaccgtacccgttctgacagggcccaaaggggcggtataagcagccggccgcggtaacgccgcgcggacacgcctgggcctggaggccctctgggcactcggacccccattaccgggataatggtagtgcacgctctccgggattcgtacacgcatagcccccacatctcttcgccattcacccccgcatactacg

SEQ ID NO: 11117 - DNA, 757 bp, Homo sapiens
tgagacagagactctttcgcccaggctggagtgcagtggcgcaatctgagttcactgtaatctccgcctcttgggttcaagcaattctcctgcccgagcctcccaagtagctggcattacaggcacatgccaccatgcctggctaatttttgtatttttagtagagatggggtttcaccatgttggccgggctggtctcgaactcctgaccttgtgatgcacccacctcggcctcccaaagtgctgggatttacaggcgtaagccactgagcccagtgcctaggactatattttaaaataagcaatgaaagattctgttttaatttgggatggactatattcatttggactcttgctccttgagctcttctgtacttaaatgggactagcagttctcatctctgagcttcggttttgtcattgagttatgttgaggattaaatactatactgtatgtgatgccagaacttagtatgttgcctggcacactaagttgactcagtaaaggttaggaactgggccagtacaataaatatcagggttttgacattcatctttagattttcaacatgaattaagacatatctgactggaagccagaagatgtgctgaatgagcatgtacagaagatgtccaccaagttgaattacactttagattgaattggaggagtttttttggcttgcttgcttgcttgtttactccaagctaaaatttaaatctggaaagatttcaccatccaagctgtctaacctag

SEQ ID NO: 11118 - DNA, 8478 bp, Homo sapiens
  misc_feature (743)..(743): n is a, c, g, or t
  misc_feature (1167)..(1167): n is a, c, g, or t
  misc_feature (1206)..(1206): n is a, c, g, or t
agcatttcaggccccggacaggaggcagtgccgcttcggccgaaggccgagccgcccgagggctctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttantgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagangatgatgatgatgaaattgatgatgatgatacaatttcngactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagcttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccagggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactata

SEQ ID NO: 11119 - DNA, 8424 bp, Homo sapiens
  misc_feature (743)..(743): n is a, c, g, or t
  misc_feature (1167)..(1167): n is a, c, g, or t
  misc_feature (1206)..(1206): n is a, c, g, or t
agcatttcaggccccggacaggaggcagtgccgcttcggccgaaggccgagccgcccgagggctctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttantgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagangatgatgatgatgaaattgatgatgatgatacaatttcngactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagcttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccagggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttcttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactata

SEQ ID NO: 11120 - DNA, 4421 bp, Homo sapiens
  misc_feature (743)..(743): n is a, c, g, or t
  misc_feature (1167)..(1167): n is a, c, g, or t
  misc_feature (1206)..(1206): n is a, c, g, or t
agcatttcaggccccggacaggaggcagtgccgcttcggccgaaggccgagccgcccgagggctctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttantgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagangatgatgatgatgaaattgatgatgatgatacaatttcngactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagcttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaacccttta

SEQ ID NO: 11121 - DNA, 6520 bp, Homo sapiens
aagcagcatggttataagtgactaacacgatattaggcaatttgtccaaatttctcattttctttataggtaaagatagcattcttatttgattaattttttgttccactggctttgaaagacaaacgattgttaaagataaaattgtttttgttctttttcttataggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagcttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccagggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactataaaaaaaaaaaaaaacccacgcgtccttcagatcaatccatctatgcaaatttatggggaaaaattgttttttaaattaaatttccaatacccaagccctaaaattgatggatgtgaccccaggtgttccccttacctcttggccccccaaaacagggacagacatagatggtgggctggaacacccctcacctcctgtattcccagaaagcctcgcgttgaggtgtgttggccagctccctagtttgtgcttactatacctggccacgcctccctacctaaggccgctggcttaaccctaggggcaggcagtgttagatcagacccagaccttctcatcccaccctcatcacatcggggagaggggactccaggggcgggaaggcaggcgtccctccatttggccagggtgggcggcgaggagggggtcactctgcaggaacactgagctctgaacacctctcgcctgctgcctgcctcacaccctctgcattcgctgtttcctctgttgggggagggggtttgtgaggggaatattagattacaccttgtcatttggaaagccccgtgtctccggcggccacagcgaggttgggggggtggtgagggaagtccatggattggccagaactgggggaaaaacaaaaagaaatgagagaaagagagagcgggtacc

SEQ ID NO: 11122 - DNA, 2034 bp, Homo sapiens
gatcccccgggctgcaggagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactataaaaaaaaaaaaaaacccacgcgtccttcagatcaatccatctatgcaaatttatggggaaaaattgttttttaaattaaatttccaatacccaagccctaaaattgatggatgtgaccccaggtgttccccttacctcttggccccccaaaacagggacagacatagatggtgggctggaacacccctcacctcctgtattcccagaaagcctcgcgttgaggtgtgttggccagctccctagtttgtgcttactatacctggccacgcctccctacctaaggccgctggcttaaccctaggggcaggcagtgttagatcagacccagaccttctcatcccaccctcatcacatcggggagaggggactccaggggcgggaaggcaggcgtccctccatttggccagggtgggcggcgaggagggggtcactctgcaggaacactgagctctgaacacctctcgcctgctgcctgcctcacaccctctgcattcgctgtttcctctgttgggggagggggtttgtgaggggaatattagattacaccttgtcatttggaaagccccgtgtctccggcggccacagcgaggttgggggggtggtgagggaagtccatggattggccagaactgggggaaaaacaaaaagaaatgagagaaagagagagcgggtacc

SEQ ID NO: 11123 - DNA, 3590 bp, Homo sapiens
  misc_feature (743)..(743): n is a, c, g, or t
  misc_feature (1167)..(1167): n is a, c, g, or t
  misc_feature (1206)..(1206): n is a, c, g, or t
agcatttcaggccccggacaggaggcagtgccgcttcggccgaaggccgagccgcccgagggctctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttantgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagangatgatgatgatgaaattgatgatgatgatacaatttcngactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattctatcttgggctttaaatttaaaattacttaagtgggccaggtgtggtggctcatgtctgtaatcccagcacttggggaggccaaggtgggctggtctcgaactcctgaccttgtgatgcacccacctcggcctcccaaagtgctgggatttacaggcgtaagccactgagcccagtgcctaggactatattttaaaataagcaatgaaagattctgttttaatttgggatggactatattcatttggactcttgctccttgagctcttctgtacttaaatgggactagcagttctcatctctgagcttcggttttgtcattgagttatgttgaggattaaatactatactgtatgtgatgccagaacttagtatgttgcctggcacactaagttgactcagtaaaggttaggaactgggccagtacaataaatatcagggttttgacattcatctttagattttcaacatgaattaagacatatctgactggaagccagaagatgtgctgaatgagcatgtacagaagatgtccaccaagttgaattacactttagattgaattggaggagtttttttggcttgcttgcttgcttgtttactccaagctaaaatttaaatctggaaagatttcaccatccaagctgtctaacctag

SEQ ID NO: 11124 - DNA, 9124 bp, Homo sapiens
  misc_feature (714)..(714): n is a, c, g, or t
  misc_feature (1138)..(1138): n is a, c, g, or t
  misc_feature (1177)..(1177): n is a, c, g, or t
ccaggagcagttccgccgggtttcactgtccgtgacttccttcggggcacctcagcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttantgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagangatgatgatgatgaaattgatgatgatgatacaatttcngactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagcttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccagggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactataaaaaaaaaaaaaaacccacgcgtccttcagatcaatccatctatgcaaatttatggggaaaaattgttttttaaattaaatttccaatacccaagccctaaaattgatggatgtgaccccaggtgttccccttacctcttggccccccaaaacagggacagacatagatggtgggctggaacacccctcacctcctgtattcccagaaagcctcgcgttgaggtgtgttggccagctccctagtttgtgcttactatacctggccacgcctccctacctaaggccgctggcttaaccctaggggcaggcagtgttagatcagacccagaccttctcatcccaccctcatcacatcggggagaggggactccaggggcgggaaggcaggcgtccctccatttggccagggtgggcggcgaggagggggtcactctgcaggaacactgagctctgaacacctctcgcctgctgcctgcctcacaccctctgcattcgctgtttcctctgttgggggagggggtttgtgaggggaatattagattacaccttgtcatttggaaagccccgtgtctccggcggccacagcgaggttgggggggtggtgagggaagtccatggattggccagaactgggggaaaaacaaaaagaaatgagagaaagagagagcgggtacc

SEQ ID NO: 11125 - DNA, 9153 bp, Homo sapiens
  misc_feature (743)..(743): n is a, c, g, or t
  misc_feature (1167)..(1167): n is a, c, g, or t
  misc_feature (1206)..(1206): n is a, c, g, or t
agcatttcaggccccggacaggaggcagtgccgcttcggccgaaggccgagccgcccgagggctctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttantgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagangatgatgatgatgaaattgatgatgatgatacaatttcngactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagcttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccagggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactataaaaaaaaaaaaaaacccacgcgtccttcagatcaatccatctatgcaaatttatggggaaaaattgttttttaaattaaatttccaatacccaagccctaaaattgatggatgtgaccccaggtgttccccttacctcttggccccccaaaacagggacagacatagatggtgggctggaacacccctcacctcctgtattcccagaaagcctcgcgttgaggtgtgttggccagctccctagtttgtgcttactatacctggccacgcctccctacctaaggccgctggcttaaccctaggggcaggcagtgttagatcagacccagaccttctcatcccaccctcatcacatcggggagaggggactccaggggcgggaaggcaggcgtccctccatttggccagggtgggcggcgaggagggggtcactctgcaggaacactgagctctgaacacctctcgcctgctgcctgcctcacaccctctgcattcgctgtttcctctgttgggggagggggtttgtgaggggaatattagattacaccttgtcatttggaaagccccgtgtctccggcggccacagcgaggttgggggggtggtgagggaagtccatggattggccagaactgggggaaaaacaaaaagaaatgagagaaagagagagcgggtacc

SEQ ID NO: 11126 - DNA, 299 bp, Homo sapiens
gaagggcctttgggaagtaattaggattagataaggtcatggggtgaggtatgatggcactggtgacttataagaagagaaagagaaatctgagctggcatgctcttgccctctcactgtgtgatgacttctccatgtcatgatgcagcaagaaggccctcaccagatggtggcaccatgcttttggacttcccagcctctagaactgtgagctaaatcaatttattttctttataatcacccagtttgatattttgtcatagcaacagaatatggacaaagaaagaaaattaatgcaa

SEQ ID NO: 11127 - DNA, 358 bp, Homo sapiens
gctatcacgtggaaagcacttataaactgtgaagtgccgtacaagtgcaagatactcttaccagcagcatgattgttcctgagagtagaatttctaatagtaggctgagcatggtggctcacacctgtaatcccagcactttgggaggctgaggtggacagatcacttgaggtcaggagttcgagaccagcctggccaacatggtgaaaccccgtctctactaaaaatacaaaaatcagtcaggcatggtggcatgtgcccataatcctagctgtttgggaggctgaggcagaagaatcgcttgaacccgggaggcagagtttgcagtgagccgagagtgtgccactgcactccaccc

SEQ ID NO: 11128 - DNA, 282 bp, Homo sapiens
tgtgtgtgtgtgtatatatatatatatatatatatatatatatatatatgtatctccccattatacaaatgaatatgatgatgatgatggtggtagtgcccaaaatgtatttaatgtgctttgtacatactagggaatatatacacacacacattacttttttttgcagggatcttgatacataaagattacatgtgtaaagtggctaggcacaatgcctagcacagaatacatacaaaatgggtatatctgttatgattagtattggtaatctcaggtaga

SEQ ID NO: 11129 - DNA, 1779 bp, Homo sapiens
tgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcatggctgagggaagcctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggacttctccagggagggtggaggtgagggtggaccccatctggctgtgctgcacagtgtcctccaccgcaacatcgaccgcctaggtcttttctctggccgtttccaggcaccttcaccgtccactctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccacttttttttttctaaataaaatttgccaacttgagaaaa

SEQ ID NO: 11130 - DNA, 1957 bp, Homo sapiens
tgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcatggctgagggaagcctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggacttctccagggagggtggaggtgagggtggaccccatctggctgtgctgcacagtgtcctccaccgcaacatcgaccgcctaggtcttttctctggccgtttccaggcaccttcaccgtccactctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccacttttttttttctaaataaaatttgccaacttgagaaaaaaattacagcaaaaaaaaaaaaagtggaggacatctatgtcgcagacggggaacaaaagggtcattgacaggccactgcgccatacgatgttccggaaccacattttttgtgtccaaggggtgactctcccggcccccaattgtgaccgcaataattcaaaaaccaggtaccgctacg

SEQ ID NO: 11131 - DNA, 1681 bp, Homo sapiens
tgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcatggctgagggaagcctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggacttctccagggagggtggaggtgagggactattttttttctcttttagatgaaatggtccgtgtaatcaaaatggttgagggtgcggaatttaattaagcgtacaaatccctttaatctaaatgcccattggccatgctgtttctaggatgtactacaatcattcagtggtatttggaagtaaatctcggtttctcaagtgttgtcctggagaact

SEQ ID NO: 11132 - DNA, 561 bp, Homo sapiens
caagttggcaaattttatttagaaaaaaaaaagtgggagagaaaaaagtgacagcgctctttagaccaaggacttagaagagaaacctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggacttctccagggagggtggaggtgagggtggaccccatctggctgtgctgcacagtgtcctccaccgcaacatcgaccgcctaggtcttttctctggccgtttccaggcaccttcaccgtccactctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccacttttttttttctaaataaaatttgccaacttgagaaaa

SEQ ID NO: 11133 - DNA, 1659 bp, Homo sapiens
tgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcatggctgagggaagcctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggactttctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccacttttttttttctaaataaaatttgccaacttgagaaaa

SEQ ID NO: 11134 - DNA, 416 bp, Homo sapiens
tggaccttgtgggtctcagtttctttatctaaaaaaatgaatgtgtattagttttggaagttgcgtaataaattaccactaacttagaagcctaaaactactaatttattatctcacagttctgtaagtcagaagtttaggcaggcttggctgggttcattgcctagagtctcgcattattatttattattattttttaatctcctaggctaagcttcctttttgggaagaaaagtagtttatttttgctggaatttctctctgtgttgttttcatcttgaggagatcaagtataaaagtgttgcgcatttactgagtaatattacaagcagaatgccacatattattaattgaaattctgattcaaatgtttatattaagtagaatttttccaacacagtgtatatgtgctaaac

SEQ ID NO: 11135 - DNA, 633 bp, Homo sapiens
tcgtgttgccatttatctcatttcttaggtctagtagtaattgcttttataaatttgagagctccagtattaggtgcacacagatttaggactgtgacattttcctgttggactagtccttttattattatataatgtccctctttgtctttttaactgttgttgctttaaagtctttttgtctgatataagaatagctactcctgtgtccatttgcatggaatatctattcccacccctttaccttaagtttatgtgagtccttatgtgttgggtgagtctcttgaagacagcagatacttggttggtgaatttttattcattctgctattctgtatcttttaagtggcacatttaggccatttacattcaatgtgggtattgagatgtgaggtactatgctattcatcatgctggttttctagaatgctggttatgctagcagtgaagttgccacgtggacagactcaggacctctggttagccagggtgttgcaagtggtagaattatctgttgttttctccttctttggtgcaggattgttctgttatgactttgtgtaatggcttgagttcattggcctccaaccaggaggtggaactttcaagacagcaccagctgctgtagcgccc

SEQ ID NO: 11136 - DNA, 377 bp, Homo sapiens
gactttgagaagcagaggtaagaatctagggaacacaaatgaatgcctgatcatagagaagagctagggaataaatttgaatggtgtaaaaatactattgttatagatgtttaaaaacaaaaatttaaaaaatactgatggtagttaaatctcttccaacaaaatttgagcaaaaattcccaaaggaaaataatatttatttagtacctacttcgtgtcaggtatagtgcaacatacgttagttaaagtacattttacattgctttttatctcagtattggattttctaggatatggtattctttattcttgcctgattccgctttatacggaaattaaaatcccaagaaagctgtttgtaaagaaatctgaaggga

SEQ ID NO: 11137 - DNA, 333 bp, Homo sapiens
gggaagtgggcatgaatcactttaattttggcattttttttctctcatgtactacagatgtggaatttatacctttgatttaacatagagaccttttcctcaattggacattgcagaatttcaacttatgtgacagttttccccccacaaaatagaagcattttatttagctgccaagaaatccaaagttgtggtggtaaaagtgagatattgaagctttcgttgccagttaaagtattgttgagcttttcacaattacttaaattggctaatgaatagagcaactcatttgttaggttgtagccagaattctctacataaagtggatctctt

SEQ ID NO: 11138 - DNA, 572 bp, Homo sapiens
cgatgaagtaactaatgtggaatagaaagagacttaaactgtataaaatatacttgcattttctgtaaccatttacggaaaacaggaagtttctcatttctagagagtgaaacctggaagaggcagtcctttcagatagtctgagatatatggccaaaaaaatatctgcggcagtgacatagcaggctacctggaacaatgcagtggcagtttgacgtgacctttctcagtatagctagctggggtgaatcatatgctagtgttctcatctggttgaattttttacatccggaaatgtgattctttcattttataaaagaactcttgggttcttttttagagtcattgattagaagtaagcagttatgtagaattttaacttatatgaaataggagtgtgttacatagggtgtgtgttaggggattatatacctaagtggatcttcattgagttgtttgaaccagaatgatgagctgcagttttaggtcactgggctctccctgtagttttatcttattcaatacttgctgattagaagcaataacaaaagtcttagataatgagaaagaag

SEQ ID NO: 11139 - DNA, 437 bp, Homo sapiens
agaagaccctccccccatgtcctatggtggcccatctcccatgagcaggtagcagggtggaaagtcctgcaggcaggaagcagacctcattcagtcctcccaggcagtcctgttctcctgctcccagaatcctgaacaagaggttttcactcaactgagcataatgggccgcgggctatggggcgctaactgctctgcaaccagaatttggacccatttccctgttgtccactcttacctcatttctatgactcctggcacatcgagtttccagactttctggggctctgtgggggtggagtggccccttcctgttggtatccccttccataggcacttagattccgctatctcggtccttctccgctctctgctttctgacctgctagacgtgttaccattcctttctttgtactccttagtttgaggatttcacc

SEQ ID NO: 11140 - DNA, 322 bp, Homo sapiens
cgttccgggtagagactatgaaagatggggaagagaggatggggttttgaggttgcaggtgaatagcgcctagaggaagataaaaacctttcttccactcaggacaggggaacagggagagaacttaaaccatagtgtgtgtgttggggttggagcggaggtgcatgtgaacactggccgctgtgagagagattgaagtgagaaagggggaaaaaatctccttgtgtgggcttctctcaggacaagaactcgcctgaactcttaccatttacctctgacccgggttcccagcctggtcggagaggagtgaggaaggcatacg

SEQ ID NO: 11141 - DNA, 326 bp, Homo sapiens
tggagacaggttcttgctctgtcacccaggctggagtgcagtggcatgatcacggcttactgcagccttgacctcccagactcaagtgattctcctgagtagctgggaccacaggcgcacaccatcacacctggccaattttttgtattttttgtagagacagggtttttgtcatgttgcccaggctggccttgaactcctgagctcaagccatctgcccacctcagcctcccaaagtgctaggattacaggcatgaaccaccatgcccagcgctgtatttatctagttattacaactaagagagtaagctaggcactaaccagta

SEQ ID NO: 11142 - DNA, 417 bp, Homo sapiens
aatgtaacaattgtaaatatgtatgcccacaacatcagagaaccaaaatatataaagctgacagtagatctaaaggatgaaacaggctgcaataaaataatagtaggggacttcaataccccacttttaagagatggacagatagtggccaggtggagtggctcacacctgtaatcgcagcactttgggaggccagtgtgagcagatcacctgaagtcaggagttctagaccagcctggccaacatgtaaaaaccccatttctcccaaaaaatacaaaaaaaaaaaaaacaaaaactagctgggcatggtggcacatgcctgtagtcccagctactcaggaggctgaggcacaagaattgcttgaacccgggaggcagaggttgcagtgagccaagatcatgtcacagtactccagc

SEQ ID NO: 11143 - DNA, 795 bp, Homo sapiens
tttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgaga

SEQ ID NO: 11144 - DNA, 555 bp, Homo sapiens
ttttctttttttgacagagtctcgctctgtcaccaggctggagtacagtggcgcgatctcggctcactgcaatctctgcctcctgggttcaagtgattctcctgcctcagcctcctgagtagctaggattacaggcgcccaccaccatgcccagcaaaattttgtatttttagtagagacggggtttcagcatgttggccaggatggtctcgctcttgacctcatgatccgcccacctcggcctccaaaagtgctgggattataggcgtgagccaccgcacccagcctatccttttttcttaataaggtaagacagaaaacaggagcagccacgtgctctcccgacctctgttgccaacagggacaggcatggaatgtgttctgaccaattagatggaggagagttgcaagttatggctcctgggaggggactggactttcttcctgacagcagccaggccacgagtgaccccgaggccagcctgagtagaaggcagtgtgaagggtcacagggaagaaggatggaggcagccctgggcactgactgtgtgacca

SEQ ID NO: 11145 - DNA, 1138 bp, Homo sapiens
cctggcaaggatgagaccatccccaatcccaaagctaagaagagggagctcagaggagagttagctggaggaacttcgtatttggggattagcatcatcttcagatcatctggctcctgagagaggcttctctgtcttaaaatatatctgttggaacaaaaattaatttgggtcaaactaaatttagagctattacgatgaagaattggggagggcaatacttaggcaataaagaacaaggtggtggagggaggcctgaataataacgatgaaagagagctgaatcagccaatatcctgatataaatgaaatgtcctaccgaatacatcccaggacggagggagtggaaaaaaacacagatttaaagcctctgcagtgagaatctttttcagaggtccagcccccacaaagaattctagacaacagacttaaaacaaatggtcacttgagaagcagagccgtgtcaaagccaagaggtgtcagatatacacttgagatatctatcttagggatgagagaaaaatgtagcttctaagggtatccaaccaaatccccacttgttttattttagaatttctaataagaaattccttcctctgtcgttcggatattatcaatagctctggcttcctgtctctaaaggaacttctgcctgattcaagggaactctgggctgtttcgttagaaggtccctgttctgatcagtaaggaacatcagcggactctcagatccattcacccttggaacatggcccactgttgcaccttgattttgccttatctcgccaactctccaagctcaggtgggccttctgctgtcactgtgcccaggccagtggtaattctctcctgcctgttgtcattgcttttaggtcgttcttgaaaagatgggtgtcacatagtctgatgtgctttatcaaagaacagaggcaagagcaacacagatcatgggggtatgaatccaggaggtcatcaacagcctcgaaagagaattagaacacgtgaattcatttaagcagcccttttctggtccacagtttattgattcaagtacatcgtgcatgtctaactaactaactgcatgaatgaaaacttattttccaaaagacagctcctctgaggccacaattttgtaaat

SEQ ID NO: 11146 - DNA, 533 bp, Homo sapiens
ccctgtgattacagcctaagcctttatacagtcttatctcagagtgatttttattacaaacaccccctccatggctgaagaccaaggcaagtccagaaaaactggtcatgaattaaactttgataaaagattccttctggcctcattttcttgtgttgatttgataccccaatagaagattttcaagtgagcaaaggataactgaggttcgtgcacactcctgacctggcagcagcccctcaggctggctgctgcctacctcagttgacgtcctggcaacacagccactcaggcaagccaggagttccttctgacctctcagaggtttgtggagtaaaaaatgtatctagtgtgagcatgcggcactttgaactacccttgtgtggaaaaattcactaaaacaatgaagaaaataaaaggtatcttttatttggattctgtgaagttggtaacttttaatgcaattggccaaaattgctaactggcaaatttctccgttcttatgtcagccagttcactcatcagaagtctca

SEQ ID NO: 11147 - DNA, 444 bp, Homo sapiens
ccaccttgtgattgttgtttttgttctctgaagtgaacgtactcttttatggtagtgttaaagtcatataataagtacttatggagtaagtaaatgtgtaagacacaagagataacagatgaataagctaagtttgtatcctcaagaagtttaaagagtgaagggagtgaagaacttagtaagacaaagatgaatgtttagaacagtgcctggcacttagtgatgttagaaatgaaccttgaaggttggcaaagattttgatagacagttttcttttgattgtgacctactgagaggtcagtataggcagaaagcacagggcacacagagaagacaagttgaaaggtatagggctttggtggcaccatgggaatgggatatgttgaagacatagtattataggtacagatggtaaatgtaatgtgagaagaaaaagagataatt

SEQ ID NO: 11148 - DNA, 397 bp, Homo sapiens
  misc_feature (390)..(390): n is a, c, g, or t
  misc_feature (392)..(392): n is a, c, g, or t
ggatggtagcaggtaccctgacatgcccactgctgctgatgttgtgaatgctttagatcaacaggcacttgcttctatcctcagaacatacggggaggagaagcatgccaagaaaatcgcttcagcaattgttcaggcacgcagcatctaccccatcaccagaacccagcagcttgccagcatcgttgcaggtagcctcattaattctcaacagtgtctaagagaaaaaattatatttacatgtgtgtgtgcattaatcccccagactccctgagggattcatttgtacttgaaatccaggatagaatcttgcctatccttctctaatgtcagctttcttttgcttttgcatgcttctcccccaaaaaacctctcccccaaatacaatanantaaaa

SEQ ID NO: 11149 - DNA, 659 bp, Homo sapiens
ttttttgagacagagtttcactcttgttgcccaggctggagtgcaatggcatgatcttggctcactgcaacctccacctcctgggttcaagcagttcttctgcctcagcctcccaagtagctgggattacaggcatgtgccaccatgcccggctattattttggtcttaaaatttcactcctgtcagaatgtaggagtgaataaatgctattcataaataaccataattattcagtatttgcagtctcgtgatgttggttattgcataaagtaagttattgcagtaaatgatgctttagaaagcaattttctctcatcagtttcgtccttattcagccttacacaaaaaaaggcatagttctgggcttaattgtgatgtaattaaaattattgagtgaacattttggctcatattttatgacattgtagttcatccccatggtcaatttaaggtagagttcttacaatatattactttcaatataggtattttattaataagaatttatttcagttggacttattaaatgagtggttttgctgagtgtatgagtctataaataaaattttaattgaacatcattggagatttagatatgttggtactgcttatctagcaacttttgtatttgtgaaaccattaaaactagagtaacaat

SEQ ID NO: 11150 - DNA, 1740 bp, Homo sapiens
aggggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcaaaaaaaaagaaagtgctctcattacaaacgccgctgtcacatccacatagtatgccagtggcgtttgtaatgagagcactttcttttttttttttttgtcgacc

SEQ ID NO: 11151 - DNA, 2006 bp, Homo sapiens
aggggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagggggaagacttgttgatttttccatatcccccggcctgacaaagaaattggggagcgcttgagtgctggggtacctgggaagtgacgccgtgaaagtgtgggagatcctgaagacagagggggacggtgaaaggcaggaagcgggcatcagaagtgcggcaggggtctcctgactgtggagctaggaagatacctggacaccaccttcatgctatggttgggtaaactgaggttcggagaggagaggcaaatagctggggtcccagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcaaaaaaaaagaaagtgctctcattacaaacgccgctgtcacatccacatagtatgccagtggcgtttgtaatgagagcactttcttttttttttttttgtcgacc

SEQ ID NO: 11152 - DNA, 1528 bp, Homo sapiens
atcgagggggtgacaggccgtcgatccactctctcagctcctgctcccgctggtggtcatacttctgggccagacttgttcttaacctcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcaaaaaaaaagaaagtgctctcattacaaacgccgctgtcacatccacatagtatgccagtggcgtttgtaatgagagcactttcttttttttttttttgtcgacc

SEQ ID NO: 11153 - DNA, 1562 bp, Homo sapiens
aggggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccactatatccctccacagtccagtctgctgcctgactccaaatcatttcctctgagctagtaaaccggcattccactagaccctttggggcacattctcgtttggcttgcagtccacggtcacacaatcgtgc

SEQ ID NO: 11154 - DNA, 995 bp, Homo sapiens
aggggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagctggcccagaagtatgaccaccagcgggagcaggagctgagagagtggatcgagggggtgacaggccgtcgcatcggcaacaacttcatggacggcctcaaagatggcatcattctttgcgagctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcaaaaaaaaagaaagtgctctcattacaaacgccgctgtcacatccacatagtatgccagtggcgtttgtaatgagagcactttcttttttttttttttgtcgacc

SEQ ID NO: 11155 - DNA, 602 bp, Homo sapiens
aggggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagctggcccagaagtatgaccaccagcgggagcaggagctgagagagtggatcgagggggtgacaggccgtcgcatcggcaacaacttcatggacggcctcaaagatggcatcattctttgcgacgactggcatactatgtggatgtgacagtggcgtttgtaatgagagcactttcttttttttctatttcactggagcacaataaatggctgtaaaatctcaaaaaaaaagaaagtgctctcattacaaacgccgctgtcacatccacatagtatgccagtggcgtttgtaatgagagcactttcttttttttttttttgtcgacc

SEQ ID NO: 11156 - DNA, 664 bp, Homo sapiens
caggggaaagaaataaggaaattgctactcaagaagtggaggcaggagtgggctgccacaatctgggaagaattgtgacacttggtaggccggaaaagtgtctcaaattttacctcgactttattaagcagccatgttaattggctggcatgtgttaaacattccactcgaccagaaaaccaagtcagcaatgatttaaggcacattaaaacgtgaatgctccataaatatttgttaaatgaactaactctggacagagcatcagggaagacttcatgcaagtggcatttggccaggttattaaggactttgcagggtggaaggcctaggaggcacaatggttggtggataattcaagcgaaggcacagcatgaagagatatagaggtgtgaaaggacacagtagacagaaagggtagggtatcagaataactcagtcatctcttagcctgttgaagccatcgtcttgagcatcttataaatatccacctcttcctagctgcaccaccaaggcccattttctttcctgtggactcccagctggctttcaggcactcattcttgcctccttctatccacctccacattgcacctgagttctttttaaccaccaaaatcagtggggccactcttgcctgaagctttttgtcaccttgctctctgga

SEQ ID NO: 11157 - DNA, 326 bp, Homo sapiens
tggaaggttctaagtggggttccttactctattttggactctactggtccaaaatatagtggtacacactattaaatgttcaacatttgggcctttggaaataatgtgacagtctctccaagagattcctgctaaactagtaaggtatgataattgtatccaaaaatccatggaaatcttttccatgaaatctgctttatttgagatgctaagaattctaatttgcctggataacacaatttggctctcttcagtgttctcatcccattcagaagtatccttctggagaggaagagctataaaatgaagagtgaagtccaatagcc

SEQ ID NO: 11158 - DNA, 431 bp, Homo sapiens
ggtcttccttcatagccaggctgagcttgtggcgtgctgcttccatgacccaaagcataatgagcagctgggtatggagggtcacaggctcaaggtctatgagatcttctatttccaaatgtgcccagtatgtaggcaggtatttgttgttttaatggtgcatagcacaaggccaagaggggcaatatgttgcattagaagccctggagcaactaatggccatcaggagtgatccacagactccagaaggcgtgaaaaagttgtcgtgaatgaggttttttgaaagcactaataggagtgatggtcaattttaatttataagtaaaaaacatactggacttatatgtacttagtgagtgtgtcacatgaatctccttgaaagaggatgtcattcatgtaatatcagacctttattcctggagaaagataca

SEQ ID NO: 11159 - DNA, 336 bp, Homo sapiens
tgagatgaagtctccctcttgtgccccaggctggagtgcaatggcgccatctcaggtcactgaaacctctgcctcccagattcaagcgattctcctgcctcagccccccgagtagctgggattacaggtgcctgccaccaggcccggctaatttttgtatttttagtagagacagggttttaccatgttggccaggctggtctagaactcctgacctcaggtgatccacccgcctcggcctcccaaagtgctgggattacaggcgtgagccacagcgcccggccaggactctttcaaagtaaggaaggttcagagcactattaaagagttccagaa

SEQ ID NO: 11160 - DNA, 269 bp, Homo sapiens
gggggccctgcaggctcccctccctgagccctgggtacacctgaccacacccggaggctcaacctccaccttgctcccctggccaatcccggtctggggcaggagaaattgaagcaactttaccaaccaacaatcttcacttaaccgccacatttctcaacccccaccccactctctagcatgtcctctgaggcagactttgtcctgttttgttcatcatgcactggacctggcacatagtaggtgctcaataaaacatctgttgaatg

SEQ ID NO: 11161 - DNA, 2045 bp, Homo sapiens
tgctgagctaaagtgggaaggagcagtaacaccaaaggaggctaattctcttcctgtcagtaggagagagtgtctgcccccagtgtgtgaaaagggaaggcatgagaagtgaaaaatcagccttctggaagcaccttcttaccacgagaaaacaggtgattcttactatctttgagactcatccagattgtgtctgtttaactcttcaggcaatatgaaggcagagaagccatttcagagaagagattttttaaaaaatcatttcgttctttggcattgtcacaggattatgatgtgggttctcataaaaatttcactccccccaaagccacccaaaggaaaggcagtgaaatggggaggaacacacatttgcctggcatcgcaagagctgccttgtagtcatgggttccagtgatcttggaccgatctcttcacttccctggacctcagtttcttccatacaaagaagttgaactggatcatagaaaagatgctgtccagcttggtaatatcagatagggagcagaagctgtctcttagcacatggccagattccggaacaacgatgatggtctccatgtttgtcctaaaaatgcatctcatctcagtagagattttcttccacctcatttgggtctcaatttaaggaaggaagaaaggaaagaaacccggggattctcttcttgaaaggaatatacttcactttctctaggcttctaggataaaaacttcctatccttcatttttcctctttaaacctgccaaaatcaagttgagtaaagataccatacagatatgaaaaagaagccacatccttaaattttcatggagtccaagagcctgctcaccgccagttagcttttcccaggatggtggtggcactgatcatctaggttgcacttttatgttcatgtcccagagcgtttcccatcagccatctcatttcatcttttcatcattcctctgaggaaaagacttcacacatgtataggactttctatatcacaaagtatttcatatccaatgtcttatttagatcttgacaatcactgtttaaggtaatttggcaagttattaatactcatgtcctcattttactgaagaggaaactgaaatgcagagagcttgtcttttgcccaggatcactcacccagtttattgggaggcagcagcacggggattaagaacatgggttatgccgacaaccaaccaggcagaattccagctctgtcagtagttagctgtctggccttaggaaagggatttcacacctctgtggcttagtttccttgtccattaaatgctcataagaatagagctttcctcacagagattgggtgggcacgggagctaaatgagctcatacgtttaagaacaacctctagcacacagtgattaataaatgtcattattattagcaaagccaggacctgggtcttccagcttctagctcagtggcatttctgctgccccacaccaggactatccttcgtatacaggtatgaacctaaagccttcagtgtttcaatgaaaagttcacccaaggtctttctgttcagtaagtctagagctaagggctcctggcactctgttcagtcctttcgctggtaaaccacgctgccctccgttgctctgggcagaatgtcaaaccttcttatgtttttaaaatttataaatcaagcactcttatttaatattactgacagcccgaaggcagacgctcccactctcctggggaagagggtcttctaatctgccatcttaaggaggtaaaagggcttgattgggtaactcattgcaatgggcacgtatttattactgtctcccggccttttctcatgctgtttgtctgctggaattaccactagtgccaggccatttgaatatttgaccatttgtcttagaattctctgaatacaaatgtttttcatacctttactatgtactttttaagaatgaagactatgttgcatgttggtttgtactctctcctgcacataaaaaatgcttagtaaatagatacacaaatgtttcttgattcctaa

SEQ ID NO: 11162 - DNA, 204 bp, Homo sapiens
tccttttccttttcctcttctatatctcagctcccttttcctccattatttgaatataaatccccaagaaatcatgaggcctttatagccgagcctcctgccatccattggtaaccttggtttgtggtcatgctgtggctaagaagtttgccaggagataaaaaccaaggatcaaaattaacctccagggcaggagtgagagag

SEQ ID NO: 11163 - DNA, 559 bp, Homo sapiens
gctatttagattaacatgatgcccccagattgtaaaggactgacacttgcccccatgttcaatctaatatgtggtagattgtattttccaggatggccacatctcccttcccacatgctcttcttacaatatggtcatgacattcctcacgtagagagatgtgtctcctgttcctttcctcttgaatctgggcaggctcgtcactacagtggaagtgattccatgtgatttctgaggctagatcataaaaggtgatgaggcctctgcctaactaggggaaatgctttctcttgagatgctcactcttgaccagcctatagagagatccacagggaggaactgaggccccagcccacagccttggttgagctccagcctgcagtcatccccaacttgccagccatatgagtgggccatcttagaagcagatcctccagtcaagccagcccagctgatgctgtgtggagtggagacaagccttctgtgctgagccatgcaaaaaattgcagatttgtgaacgaaataaatgattgttattgttttaagctaaaaaaaaaag

SEQ ID NO: 11164 - DNA, 524 bp, Homo sapiens
attaatttcaaccagacaggatgaaacagagtagcaatgatggtttccattctttgacttcctttctgttataaaataacaacatggttcaaggagctatgtctgggacattaacaaagccaaaatcttgattagcaagatgtaatgttgaaagtactggttccaagcttcctgaaataatggagagatgataaaatagaaagtttaatagaaaagtataattaatggtaagaatagcagtttacatttcttgattattaatcaatgccaaggatgtatattcagtctagaatttacagccctcaatatcttaaactcaccctacctttcaccctacctcaccctatcctacctcaccctaccttatgtctcaacagattcccctccccatagctaaaccttccacgcgcagggttctggccagccttgactattcatctttcccacactattcaatattttctggatttcatatatcaattatgcctcctccttgctttctttttctattttgttaaaattct

SEQ ID NO: 11165 - DNA, 665 bp, Homo sapiens
gaaagcatcatgatgctttcttttgtatcttctttcgtttcttctttttctttttcaatttcagcaacatacttctcaatttcttcaggatttaaaatcttgagggattgatctcgcctcatgacagcaagttcaatgtttttgccacctgactgaaccacttgctcgtgcactttacacacatgagagaattggaagctaaagctaccaaagacgtagaaagaaatcttagcagggatttagtgcaagaagaagaacagttgatggaagaaacagaaaaagaaaaaagacgacaagaaaaagaaggaagctgctcaaaagaaggccactgaacaaaaaatcaaagtgccagaacagataaagcccagtgtaagccagcctcagcctgccaactctaataacggcacttccacagcaaccagcactaataataatgccaagcgagctacagccaacaatcagcagccacagcagcagcagcaacagcggctcgggcctctccccgcggcgctgcggagggcttgagctcgcgagcctccttcgccgcgccccacttgctcgtgcactttacacacatgagagaattggaagtaaagctaccaaagacgtagaaagaaatcttagcagggatttagtgcaagaagaagaacagttgatggcaagaa

SEQ ID NO: 11166 - DNA, 2181 bp, Homo sapiens
  misc_feature (307)..(307): n is a, c, g, or t
gaattccgcctcccaaagtgcacgattacaggcgtgagccacgataaagatttcttttggacacagtaataacttcacttctgtttactgagtggttacaacacactgggcacttgaccaagactgttgctactttatggaggagaaagacacagaggtaactcagatggtgaatagtgggctgttttaattccagggtgggagctcttaacccttgaatggagatttttctctgagtgccctcaccagtaacatgggggtgtttcacttcacttatctgacagtggtatctgtgaggatacattanagcatttcatagaaacattcaactgctaccaaagtataaggtggtattgtgtcagtcattaacgaatagccactgtttatatagccttatgttctgtgttttataaacatgaagacatttaaccttaggatagctctgcaaggtgtaggtactatctccattttaccgagaaaacagcaggctcagttaggtttatacaacttgcccaaagacagaaagcttgtaaaggcagggctggggttgaaacctggcaccaaaagctcatacaccatgcatctctgtacttctccaactgggtttacttacactagcttaaggcatttccatccgttttatttctttctttccactcttttatgagtcaaaaatttccctatttgcagtttccgatttatttttcagatttaagatagagcatccagattatttatctcattttgattcatctcatagataacgttatctttgtctttagttccatgttctgagtttgtcttatatgattcagatattacatttttagcaaatacagacattgttaacttagcctttttgtaagaaaaccagcaggttgttttctaaccttgtgttgttcttgtgttgtcttccaaagatgaaaaatagagaccaaacacattaacaatgaggcagaataagaacagttgccaaggaatagaggattcccttaggactactgaaaattggttggccacatttgttctttgagtcattgcgagttccctggttttgtaatgatccgatgatgatgtctttgaccagagagtaatgtggtaaaagagatagtgaacatgagttgttgtcttggccgaaggtccctgggcccttattgggtaggtaggtagcagaagtgaaatatgactcttggcagtgacatctcctaacaaaatttgagcctgtaaatgaggatatccctgctcacagaaagcttctgtttttttaggattatttttcttagtgcctttgaatttagatggcttactttggaggtacactttactggctaatcttttccaccccttttcttttgttgggattagtgccagaacagataaagcccagtgtaagccagcctcagcctgccaactctaataacggcacttccacagcaaccagcactaataataatgccaagcgagctacagccaacaatcagcagccacagcagcagcagcaacagcagcagccgcagcagcagcagccacagcagcagccacagccgcagccgcagcagcagcagccacagcagcagccacaggccttgcctcggtatcctcgtgaagtacctccacgatttcgccaccaggaacacaaacagcttctaaagaggggtcagcattttcctgttatagcagcaaaccttggatctgctgttaaggtgttaaacagccagtcagaaagcagtgctttaacaaatcaacagccacaaaataacggagaggtgcagaacagcaaaaaccagtcagtgaataagtagcagatcctggactcacatcaagatctgtctgactccaaagatatgcttgtaaccaccatgctgtgctttggcaacatacaggatgtgattggtaatgaggaagaggacacaaatatataaaccacagtacttcaggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaa

SEQ ID NO: 11167 - DNA, 1006 bp, Homo sapiens
gcggcggcggcggcagcgggtcggtgtagaaaatggcgctggtgcagcggctcgggcctctccccgcggcgctgcggagggcttgaggctcgcgagcctccttcgccgcgccccacttgctcgtgcactttacacacatgagagaattggaagctaaagctaccaaagacgtagaaagaaatcttagcagtgccagaacagataaagcccagtgtaagccagcctcagcctgccaactctaataacggcacttccacagcaaccagcactaataataatgccaagcgagctacagccaacaatcagcagccacagcagcagcagcaacagcagcagccgcagcagcagcagccacagcagcagccacagccgcagccgcagcagcagcagccacagcagcagccacaggccttgcctcggtatcctcgtgaagtacctccacgatttcgccaccaggaacacaaacagcttctaaagaggggtcagcattttcctgttatagcagcaaaccttggatctgctgttaaggtgttaaacagccagtcagaaagcagtgctttaacaaatcaacagccacaaaataacggagaggtgcagaacagcaaaaaccagtcagtgaataagtagcagatcctggactcacatcaagatctgtctgactccaaagatatgcttgtaaccaccatgctgtgctttggcaacatacaggatgtgattggtaatgaggaagaggacacaaatatataaaccacagtacttcaggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaa

SEQ ID NO: 11168 - DNA, 387 bp, Homo sapiens
gcggcggcggcggcagcgggtcggtgtagaaaatggcgctggtgcagcggctcgggcctctccccgcggcgctgcggagggcttgaggctcgcgagcctccttcgccgcgccccacttgctcgtgcactttacacacatgagagaattggaagctaaagctaccaaagacgtagaaagaaatcttagcaggtaagatgggcgagctttccgtctcccgccccacgataatcgtatatttctactccgattcgccttttctgggttgagaagttcccccgtgacattttcttccgcacccggagagcagacattcgggagaagcggcctgggggaatactggagggattgcggggagatgcgtaattacgcgtgtgtttctttcttta

SEQ ID NO: 11169 - DNA, 262 bp, Homo sapiens
ttgtttttttgtttcagagaattggaagctaaagctaccaaagacgtagaaagaaatcttagcaggtaagatgggcgagctttccgtctcccgccccacgataatcgtatatttctactccgattcgccttttctgggttgagaagttcccccgtgacattttcttccgcacccggagagcagacattcgggagaagcggcctgggggaatactggagggattgcggggagatgcgtaattacgcgtgtgtttctttcttta

SEQ ID NO: 11170 - DNA, 1460 bp, Homo sapiens
tgcgctccgccgctcgcgcctcgggctcggctcgggctccgggatgtccgcgctgtgcgaccctcccggggccccagggccacctgggcctgccccggccacccacggtcccgcgcctctcagtgctcaggagctgtcccaggaaatcaaggcttttctgactggcgtagaccccattctgggccaccaactctcagcccgggaacatgctcgctgtggtcttctcctgctccgttctttgccacctgctcgggctgctgtgcttgaccacttgagaggtgtctttgatgagagtgtccgggcccacctggctgccctggatgaaacccctgtggctggtccacctcacctccgtccacctccaccctctcatgtccctgctggtggacctggtctagaggatgtggttcaggaagtgcagcaggtgctgtctgagtttatccgggccaacccaaaggcctgggcacctgtgattagtgcatggtccattgacctcatggggcaactgagcagcacgtactcaggccagcaccagcgtgttccccacgctactggcgctcttaatgaactgctacagctgtggatgggttgtagggccacgcgtacattaatggacatctatgtgcagtgcctctcggctctcattggtagctgcccagatgcgtgtgtggatgccttgctggatacctctgttcagcattctccacactttgactgggttgtggcacatattggctcctcttttcctggcaccatcatttcccgggttctctcctgtggccttaaggacttttgtgtccatggtggggctggaggtggagctggcagtagtggtggaagctcttctcagaccccctctacagaccccttccctggatctcctgccattcctgcggagaaacgggtgcccaagattgcctcagttgtaggcatcctaggtcacctggcctcccgccacggagatagcatccgacgggagctcctgcgaatgttccatgatagcctggcagggggatctggaggccgcagtggggacccctcccttcaggccacggttccgttcctactgcagctggcagtcatgtcaccagctttgctgggcactgtctctggagagcttgtggattgcctcaagcccccagctgtgctgagccagctgcagcaacaccttcaaggattcccccgagaggagctggacaacatgttgaacctggctgtgcacctggtgagccaggcctctggggcaggtgcctaccgcttgctgcagttcctggtggacacagctatgcctgcttcggtcattaccacccagggcctggctgtgccagaccaccgtgcgtgaggcttgtgaccggctaatccagctgctgctgctgcacctgcaaaaactggttcatcaccggggaggtctcctggggaaggggtgctaaggcccgcccccaactccccgcttgggtgcc

SEQ ID NO: 11171 - DNA, 413 bp, Homo sapiens
tttttcttatgagggaagtatttttattatccctatttaacataaaaggcaaagctcatacaggaaaggtaagttgcctaacatctcacaacactcttaagtctgtttcttttgcttccttgtagtgctcaggagctgtcccaggaaatcaaggcttttctgactggcgtagaccccattctgggccaccaactctcagcccgggaacatgctcgctgtggtcttctcctgctccgttctttgccacctgctcgggctgctgtgcttgaccacttgagaggtgtctttgatgagagtgtccgggcccacctggctgccctggatgaaacccctgtggctggtccacctcacctccgtccacctccccttctgtcgtcttctgcgtcagcccgtgtcgacgcggccgcgaattc

SEQ ID NO: 11172 - DNA, 1462 bp, Homo sapiens
tttttcttatgagggaagtatttttattatccctatttaacataaaaggcaaagctcatacaggaaaggtaagttgcctaacatctcacaacactcttaagtctgtttcttttgcttccttgtagtgctcaggagctgtcccaggaaatcaaggcttttctgactggcgtagaccccattctgggccaccaactctcagcccgggaacatgctcgctgtggtcttctcctgctccgttctttgccacctgctcgggctgctgtgcttgaccacttgagaggtgtctttgatgagagtgtccgggcccacctggctgccctggatgaaacccctgtggctggtccacctcacctccgtccacctccaccctctcatgtccctgctggtggacctggtctagaggatgtggttcaggaagtgcagcaggtgctgtctgagtttatccgggccaacccaaaggcctgggcacctgtgattagtgcatggtccattgacctcatggggcaactgagcagcacgtactcaggccagcaccagcgtgttccccacgctactggcgctcttaatgaactgctacagctgtggatgggttgtagggccacgcgtacattaatggacatctatgtgcagtgcctctcggctctcattggtagctgcccagatgcgtgtgtggatgccttgctggatacctctgttcagcattctccacactttgactgggttgtggcacatattggctcctcttttcctggcaccatcatttcccgggttctctcctgtggccttaaggacttttgtgtccatggtggggctggaggtggagctggcagtagtggtggaagctcttctcagaccccctctacagaccccttccctggatctcctgccattcctgcggagaaacgggtgcccaagattgcctcagttgtaggcatcctaggtcacctggcctcccgccacggagatagcatccgacgggagctcctgcgaatgttccatgatagcctggcagggggatctggaggccgcagtggggacccctcccttcaggccacggttccgttcctactgcagctggcagtcatgtcaccagctttgctgggcactgtctctggagagcttgtggattgcctcaagcccccagctgtgctgagccagctgcagcaacaccttcaaggattcccccgagaggagctggacaacatgttgaacctggctgtgcacctggtgagccaggcctctggggcaggtgcctaccgcttgctgcagttcctggtggacacagctatgcctgcttcggtcattaccacccagggcctggctgtgccagaccaccgtgcgtgaggcttgtgaccggctaatccagctgctgctgctgcacctgcaaaaactggttcatcaccggggaggtctcctggggaaggggtgctaaggcccgcccccaactccccgcttgggtgcc

SEQ ID NO: 11173 - DNA, 419 bp, Homo sapiens
gtctccatgccaacctctcccctgaactccaaactcacgtaccagctgcctgcatggatgcctaatggatatccccaaaccgaatgtgtcccagatggaactcaagcccattcctcctgccactttcctgacctcagcagagggcaatcccattttggcagttcttccaaataaaaaacaggataccactttgacccatctgtcatgaccttcagcagactccgttggttccacctgcaaaccataaccaccttccaagccagcatttgctcttcccactgtaggccagcttggcccttaaggaacatcagtcgggtctgggtgtgtccccagggcctggaaatctcccaggcccacatgacctgagtgtccgctccggtcaggccctgtggccccacagaggacaggcacacctgtcg

SEQ ID NO: 11174 - DNA, 424 bp, Homo sapiens
gggggtggggtaaagagaaggttgttcctttgggttggatcacaggggtgagtatacaaggcagcagcagctgctggctctggagctctggttgctacgtgagaagcttgagtagtgctggctgctgtctccagggaaggacagcagtgcagcgtccattaatgctgctggctgcagggagcagcacttaggcgatggctgcttcaggactaagaagaaaccttgcttttctgggaattttcactgctgagctggtttgctttttattggtggggagatgggaattagtaattcataatctcctacccatttatggatattggcatctggaaactggatcatggttaaagcctttctttttttgtttgtttgatttgatttttgttttttggcagatttttgttttttatctagacatttgtgc

SEQ ID NO: 11175 - DNA, 418 bp, Homo sapiens
aaccagaagcactgaatgaaaagatttaaaatttactgcaggttttaaaaagaaagtgcaaagttaaacaacatgacaaagaaggagaaagtaacttatatcgcagatacaaaggcttcctaagaatctaggaggaaaatggaaaatgctcagtttcattcagaagagaaatgtaaattgaaactttactggcataccactttttatttataaggtttgcaaaaaaaaaaaaaaatccagaagctcattaacatattctaatagtgagcctggaccgatcaaataccactgaagagaatgcaaaatggtgcgccacctctggagaggaatttggcaatatctagtaaaattacatacacactttaccctttgcactctgcattcccactcctaggattttatcccaaagttaaactgg

SEQ ID NO: 11176 - DNA, 261 bp, Homo sapiens
agcacccatcaggagtataaggaatttttctagacttaatgtatttatttgctttagcaacagccgtagaaggttgatgattgagtaggagcgaacacacagcttaaaccttaggctttggagaatcgaaggtccatagtcctccaaatgtgcgtgtgaaacaagcagctaaacgtgagaaaccatgaggctgagttgacaaccttaagttggtcatgattgagggaaatggatagtgggttttgtgtgcgtgggtttttt

SEQ ID NO: 11177 - DNA, 277 bp, Homo sapiens
gaggttgcagtgagctgagatggcgccactatactccagcctgggcaacagagcgagactctgtcttaaacacacaaacaaaaatgaccatccatatgacccagcaatctcactcctaggcatatacccaaaagaactgaaaacaagtgttcaaacaaaaatcggtacacaatgttcacagcgcattattcacaatagccaaaaggtagaaacaactcaaatatccatcaactgatgaaatgaaatgtgctatatccaaacaatagaatattagcta

SEQ ID NO: 11178 - DNA, 354 bp, Homo sapiens
agtcctttccccctcccgtcctgtccccatcagtgttgaaatgtatgctacagttattatggttgtaatttgttatgccatgttgatcttcttgtgcttttcatatcagaacaatgcatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctgagcaatactagaatggttatatatatttaagtttgtattaaacc

SEQ ID NO: 11179 - DNA, 470 bp, Homo sapiens
gtgtactagaacattcaaagaaaactaagaggggagagttaactataaaataataaactaatgatattgggttcatatgtaccttacacaatatatgttatatgctttgagctgtgcacaacctttctaccttactgagctttattagaatttcagactctattctggtgtcctctctttttaatttttcagaattaatctagtcagggaaaggtatagtctcattatttctttcttagacaacctatgtaggttagctgacagcctcaaagaactcacttgacattcaatgtaagtatgttttagaagtgtcttaaggcttctcctaggagacaggttcaaaaatggtgaggccaggcgcggtggctcacgcctgtaattccagcacttgggaggccgaggtggaggattgcttgagcccaggagttcgagaccagactgggcaacattgtaagaccctgtctttatta

SEQ ID NO: 11180 - DNA, 605 bp, Homo sapiens
attgaatgtcattttactttctggcatgtgaaccaagtgattacaacagattcctggatctcatgtcaaagattcctttgatgtgagaatctgaacatttatttatatctatagatttacaattttagtccattttgagagttatagtatctcttgttacatattgttacattgaattatagatctattcataggcaactttaaatgcccgtagcttttgagtttgagctgttacataggtagctgcatggctttttctgaacatccacaaagtaattactattcaaagtgcatactaataaatcaatgaagcctccacattatttgggaagtagtcaatcaaaggctaaattcaatgttatgataacttttaggcagtagttctttagacttctgtatttaattgaacagaaaaaatgtaaaaaaaggggaggagattgatagggacatcattaataaaacaactactatctactatcactatcatttaacaaaaggacattttaacaccaggaaaaggggaggggtctcagtgtaggggctctacccttttaaggttaaattaaatttaaggttttatttatagacctttatgttgtatttat

SEQ ID NO: 11181 - DNA, 724 bp, Homo sapiens
ggtttggtttaaagctacagaaaggagagagctagagaagaagaaaaaaggtattttgcctgaggacttgaagcttttttttttcccttttcctccgcatgactgactttctcacactcagattccctccagcctgccagagacgtggtagctgccctgccaagagctatcctgggagggctattgaacgagctttgagtaagtacacacacggtggattttctcctcccctcggtacctgctctgcacctgtacagggagcagtcccacacatatcacctgatcacagccctttcagggaccgtgagaaaaataaagcccaggatagaaaagacatgtttgtcatctctccagggctgcagccagcttccagcagtcccagtgcccagaaacagcacattccaggccggctgtgcatgcatgtttgctggggcgcgtgccaggtgggggtgctgggaaggggggggcaactagaggtcacctttgtaatgaccaccttgctgcccccgttctctggcatgtgctgactggtagcttgagaaccctctactagaatcagtatcatagtctttctagatagcagtctgtatgtgctgatcgcagaattcataaccaggatttttttttttttacctataaagcccctgaaatggaatttcaacgtgtgtctgtatgtgcatatttaacaggagcttaataaatattttccaaatgcataaatgga

SEQ ID NO: 11182 - DNA, 444 bp, Homo sapiens
ctgctttgagaaggagccctgcagtgccttgggccttgccaccttccacggtggtctgagtcaagtcttttgggcttccacttggccaggataggtgttgcttggtggcttcactttctgggcacaggcttatcctcttatggcagagggagcacttccctttaagaatgaggcttgaacaattaaaaaaaaaaacacattatttagaatccagctttgaatccaacactccccagcaatgccagactgaatgcatgagattcctcatgctgcagtgccctgagccctgcctggacctgggatctggctgtcactgagcacaaatagggccactgtgtccaagtgctgcctttggaagtggaaatgtattttcagattttgttttcctttcctgtgatctttgtaaatttgggacaagtcctttggattgcttaagtgtttttc

SEQ ID NO: 11183 - DNA, 341 bp, Homo sapiens
aatacctgaggctgggtaattcataaggaaaagaggtttatttggcttccaattctgcaggctgtacaagaagtatggcagtgctatctgcttatggagacggactcagacagcttctagtcatggcagaaaggggaaggggagatggcttgtcacagggtgacagaaggagcaagacagaggggagagaggtccaaaactctttaacaatcagatcttgagaggactaagagtgagaattcactcaatcctgagataatagctccaagccattcgtgaggtatctgccctcatgacctaaacacctcccactaggccccatctttagcattggggatcaa

SEQ ID NO: 11184 - DNA, 403 bp, Homo sapiens
tcacgcttgtaatcccagcacttttggaggccgaggtgggtggatcacgaagtcaggagatcgagaccatcctggctaacatggtgaaaccccgcctctactaaaaatacacacacacacacacaaaaaaaaagccgggtgtggtggtgggcgcctgtagtcccagctactcaggaggctgaggcaggagaatggcgtgaacccgggaggcggagcttgcagtgagccaagattgtgccactgcactgcagcctaggtgacagagcgagactctgtctcaaaaaaaaaaaaaaaaagtagaggctgagaagtgtccagaaggtgagtacatacgagaagaatgagtcctgtttgattgccagcatagcaggatctaaccgtgtgcttccccctccttgagagc

SEQ ID NO: 11185 - DNA, 333 bp, Homo sapiens
  misc_feature (189)..(189): n is a, c, g, or t
actctgagcgcagtttgcttcagtgtccccagcagtttttgctcagtgtccccacgctgaattcttgaaaactcctccaactgcagatcagcctcccccacggcctgcagctcctgtcctccccacaaacactgtgtcctcagcaaagcctggcccagcactggtgaagcgccatctcctgtgacacanacactccagcgacagtttgcttcagttgtccccaacagttcctgaattcttgaaaactcctccaactgcagatcagcctcccccacggcctgcagctcctgtcctccccacaaacactgtgtcctctattggcttagccaatcg

SEQ ID NO: 11186 - DNA, 2100 bp, Homo sapiens
ttccaggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgctcagtgtccccacgctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagccactcaatgacaaaaatagtaacagtgggaattcagctttgaacaatgccacacctaacacaccaagacagaatacatctactcctgtgagaaagccaggacctctgccttctagcctggatgacttaaaggtatcagaactgaagacagaactgaagttaaggggtctgccagtgtcaggcaccaaaccggacctcattgagcgcctaaaaccctaccaggaagtgaacagcagcggccttgctgctgggggcatcgtggcagtgtcatcatcagccattgtcaccagtaacccagaagtcactgtggccttgccggttacaacactacacaacactgtgactagctcagtctctactctcaaggcagaattgccacctacaggaaccagcaacgcaacccgtgtggaaaatgttcattcccctctgcccatttcaccatctccctccgaacagtccagtctcagtactgatgacacaaacatggcagacactttcaccgagattatgaccatgatgtcgccttcacagttcttgagttcatctcctttgagaatgacaaataatgaagacagtctgagtcccaccagcagcactctgtcaaacctggaactggatgcagccgaaaaggatcgcaagcttcaggagaaagagaagcaaatcgaagagctgaagaggaaactggaacaagagcagaagctcgtggaagtgctgaaaatgcaacttgaggttgaaaaacgagggcagcagcagcggcccctggaagcccagcccagtgccccaggtcattctgtcaagtcagatcagaagcacggcagccttggctcctccatcaaagatgaggcctcactccctgactgctccagctccaggcagcccatcccagtagcca

SEQ ID NO: 11187 - DNA, 1349 bp, Homo sapiens
  misc_feature (1146)..(1146): n is a, c, g, or t
ttccaggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgctcagtgtccccacgctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctgctgtgtcatctcctagcccagcccaccntgccagggccaggacccagacttcagcaaatgtggctcacacagtgccggcacatgccgggacatgcggggtggctgttgtcatgggcgtctgccccttcacaccaggcagtggggctcagacccaccaggaaggtggccgttcagcccgagctcctgaaacggaatcccaggtcctggttggagagggacacccctgattac

SEQ ID NO: 11188 - DNA, 1052 bp, Homo sapiens
  misc_feature (979)..(979): n is a, c, g, or t
ttccaggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgctcagtgtccccacgctgaattcttgaaaactcctccaactgcagatcagcctcccccacggcctgcagctcctgtcctccccacaaacactgtgtcctcagcaaagcctggcccagcactggtgaagcgccatctcctgtgacacanacactaatagttaataactgagatcaatttgtaagaaatgtttaattattcctgtagcataacatctggccct

SEQ ID NO: 11189 - DNA, 628 bp, Homo sapiens
ttccaggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgaacattcctccatgttattaaatgttcctctcagctgggcatgatggctcacacctgtaatcccagcactttgggaggctgaggtgggaggatcatttaaggccaggagctcgagaccagcctgcacaacatagcaagactcctctacaaaaaatgtttaaagtagctgggcgtggtgatgcacgcctgtagtcccaactactcagaaggcaagagagaggttcccttgcaaccacaatctgggtgacacagccagatcctgtctttccctgtctgttaaaaaacaaaaacttctgaaataaaattactttttacttctttggctcattgtaagcact

SEQ ID NO: 11190 - DNA, 587 bp, Homo sapiens
ttccaggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatggaaattttcatcgctcacagagatattccagagtctccagaagacacaatactgtcaatttttaacataaacaaatagagatagatgacatatacttttaatacttaagatacaaaatctaacaaagtaatgttaaaatttgcaaacactctaagcatgcacattaaaaaatagaattaaggtttttttctggaattactataccttccacagttctgatgagtcccacactcacaagtatatttgtaaatttcagttttttaaaagccagaagaaataaaactgctttccctgcagag

SEQ ID NO: 11191 - DNA, 397 bp, Homo sapiens
tctttggtagtgacgttacctttggaaataatctttagattcagccattttagcacaagcagatgatttcatgctggaatggcattggaaagtaggttcctgtgctgatgccggggaagtacattgtggatatgactgcattctcctcccactttctccatctccggtgtgttgcaccgtaatttcacaagtggcaaagctatctcagtgatgactaagaagtcaggagcttcttatttgagtatttattatattaatgggtattggatatagtcatattctcagtctttggctgcctcatctttgtctacaaaatgaatattttctattcattatctgttcaggaaattttcatcgctcacagagatattccagagtctccagaagacacaatact

SEQ ID NO: 11192 - DNA, 5541 bp, Homo sapiens
ggcaaacgccagcaacagcccctcgtcactgcggctcctgaatgagccacagaagcgggactgtggcagcaccggggcaggcactgacaacgaccccaacatctacttcctgatccagaagatgttctacatgctgaacaccctcacgtccaacatgtcccagctgcacagcaaggtggacctgctctcccttgaggtgagccgcatcaagaagcaggtgagccccactgagatggtggccaaattccagccgccccctgagtaccagctcacagccgcagagctcaagcagatcgtggaccagagcctgtcagggggggacctggcctgccgcttgctggtgcagctcttccccgagctcttcagcgacgtggacttctcccggggctgcagtgcctgtggctttgcggccaagcgcaagctggagtcgctgcacctgcagctcatccgcaactatgtggaggtctactacccctcggtgaaggacacggctgtgtggcaggccgagtgcctgccccagctgaacgacttcttcagccgcttctgggcccagcgggaaatggaggacagccagcccagcggccaggtcgccagcttctttgaggcagagcaggtggaccccggccacttcctggacaacaaagaccaggaggaggccctgtctcttgaccggagcagcaccatcgcctcagaccacgtggtggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtatgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatagaaaaacatgg

SEQ ID NO: 11193 - DNA, 5044 bp, Homo sapiens
tgttatttattttgagatttatcatgagtactttgtgtactgtatcaataatatcttattgctgagtaatattccattgtatgaatataacatagtttatatacttgtggatttttcagaaacggggggttgtttctactgtctcacagttgcacaggccagaaagttctgggccggctttttctggtctaagatgtgatttcaggcagtggtggagttggcatcagacagccgctctccacagcccagttctcaggtgggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtatgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggatttttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatagaaaaacatgg

SEQ ID NO: 11194 - DNA, 5141 bp, Homo sapiens
tgttatttattttgagatttatcatgagtactttgtgtactgtatcaataatatcttattgctgagtaatattccattgtatgaatataacatagtttatatacttgtggatttttcagaaacggggggttgtttctactgtctcacagttgcacaggccagaaagttctgggccggctttttctggtctaagatgtgatttcaggcagtggtggagttggcatcagacagccgctctccacagcccagttctcaggtgggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtatgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggatttttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatagaaaaacatgg

SEQ ID NO: 11195 - DNA, 5098 bp, Homo sapiens
tgttatttattttgagatttatcatgagtactttgtgtactgtatcaataatatcttattgctgagtaatattccattgtatgaatataacatagtttatatacttgtggatttttcagaaacggggggttgtttctactgtctcacagttgcacaggccagaaagttctgggccggctttttctggtctaagatgtgatttcaggcagtggtggagttggcatcagacagccgctctccacagcccagttctcaggtgggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtatgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatagaaaaacatgg

SEQ ID NO: 11196 - DNA, 497 bp, Homo sapiens
gctcacccatcctctgtcaaaaccaagcttgcctgctgggttcattgagggaagactgacagagagtgtgctggtgtgagggtcccctggaggagctgaaggacgggaggaacaagtattattatcccatcttcccatctcagagatcaagaaactgaggcccagagaggccctgaattgtacatgttcaaagggcaaattaaggccgggcacagtggctcgtgcctgtaattccagcattttgggaggctgaggcagacggattgcttgagcccaggaatttgagaccagcctggggaacatggcaaaaccctgtctctacaaaatataaaataaaattagctgggcatggtggtgtgcgcctgtggtcccagctactcgggaggctaaggcaagaggattgcttgatcctcttgaggtcgagactgcagtgagccaagattgcactactgcactccagcctgggagacagagcaagaccctgcctcaaaaacaaa

SEQ ID NO: 11197 - DNA, 304 bp, Homo sapiens
ggagaccaaaacatggtgaagaggtagtgtgctttgatatgtgacatcacaaagcacactacctcttcaccatgttttgtataattagtaagacatataatcattatgtttgagctcattggaaatgaaatcacattctaccagggagtaaatggcaatgcacttgagtctggggtcctcatgtcatgactgccactaaaaacaaacagacataaattgttttccctaaatacatttttttctgaaatattgctatagtgagattattgagtgtgtatgtgacctgttattactggtgtcgacg

SEQ ID NO: 11198 - DNA, 800 bp, Homo sapiens
catggtggcgggcgcctgtagtcccagctactcgggaggttgaggcaggagaatggtgtgaatccgggaggcggaggttgcagtgagctgagatcgtgccactgcactccagcctgggcgacagagggagactccgtctcaaaaaaaaaagccagggagaacagcacctcaactgatttattttatagagtaaaagttattttgctataccttttgtaagcagcgtgtactgtgggaaatgcaaactagcagttgttagcaccatccagaaatttctgtcagttccatttcaaatagtttaaatactggctcaaatctctaaaccccaccctatggctacttttcccccagctatatataatggcattctagcaagatattttggatcctcataacttgtgacaaaactgccctatactaacaacaaatcattgtaattatagatctcaaattatgttaaattgctatagttgcaaccaacagcaagaatttgtattttagaatatgttgtgtcttctcattgaccaaaaaataaaaataaaaataaaaataaatcctcaggccctgataaactgtagaaatagcttttctatctttgcagttaaagattttcatcttggaagttatggttaaaaaatttttaaacagttaaaatagtgtagctgtgcttaaagcttctggtaaaagccagtatgctttgtagagcccttatccccctcctgctttttatttgtttttagctcactaaatgatataaacactgatttttccatatatagcactgaataaactgtcatgcc

SEQ ID NO: 11199 - DNA, 463 bp, Homo sapiens
aggataccctggcctgtggcgcgaggtcacaacaggtgagcctcattttgagttatcacttaataaacatttcaagcctttagtagagacttgaaacatgttttcaaggctagtgaacgctgtacaggagaacctgaaaagcaaattcgtgaaatgatttttagttttaagatttgggttctggccagacgtggtggctcctgcttgtaatcccagcactttgggaggctgagacaaggcggatcacttgagtccaggagttcgagaccagcctgggcaacatggcgaaaccccgtctctacaaaaatacaaatattagctgggcatagtggcccacctgtagtcacagctactcgggagactgaggcagaaggatcacttgagcccaggaagtcgaggctgcagtgagctgagattgcaccactgcactttaacgtgggcgacagagtaagaccctgtctca

SEQ ID NO: 11200 - DNA, 958 bp, Homo sapiens
acagataacagagaagctgaaagaaaagccccagaggaaacattctgtggagacatccttagcactccttgcaaactagcctgtctacaaccttatgtttggagggagacttgttcagcatcagcagcaaagtcatttcaggtccaacaattcccaaatagtgtaaggtcaagggatcctcaaaacagtgccttttccttaaggcaacacttttgggttctagtatgtagtaagagagcactggatcactcttttgttcaccccaatccttagttctgctttgacacttgctagatatcccatttctttgcctaaacacatctctgatgtctaccaactccaggtctccatagcaagagaataaccaagcttgaaccaaagttatgtctgtataactgtaacattcttcatcttgatttctatctcctccagtttctcacaactccttccgtgttgtacaagccccagtccagcacaatactctgccctaatcactctgccctccatccatcctctccagcagagtcaatctctaagtggttccgagtcgtagttcactgaccacagaggacttcttcaaaatgtccttctaagatggctactgagaagtttggaagatggcaagaaaagtgcctctgaaacagtgactccaaaattgactgccaagtcaacagaaaatgttgaattgtttcctaatcaatctcatatgacctccataagaacagggataatacttatataatacctattcagatacagataccaaaatattattaagagaacaggtgaagagtggcttaattcacaccattaacatgtaaacatgttacatgttacaaacatgctcctcatgtaatccttatactaaagtttgagatttactggtatcaacagacatttaaggctaggaactgactgtaccaagatgttagaagtttaagtaatactgaccccccaa

SEQ ID NO: 11201 - DNA, 809 bp, Homo sapiens
atagtacatgattccccagcttcaataatggactaatgacccccggaatcccaccgctatagcctgcacttccccaggaattcctgtttaaggcgtctctcaatgaagaccacaaacaggaaatggaggagtggggagttgcctgacatcctggaaactacgttcttaaagaactgcaggcaatgggcgagagttctaatacatggaacagttacaggacactaagttctagagcaattcatctccagaacaaaaactgaaatggaagcaagaaaaaaataagtttctcacaactccttccgtgttgtacaagccccagtccagcacaatactctgccctaatcactctgccctccatccatcctctccagcagagtcaatctctaagtggttccgagtcgtagttcactgaccacagaggacttcttcaaaatgtccttctaagatggctactgagaagtttggaagatggcaagaaaagtgcctctgaaacagtgactccaaaattgactgccaagtcaacagaaaatgttgaattgtttcctaatcaatctcatatgacctccataagaacagggataatacttatataatacctattcagatacagataccaaaatattattaagagaacaggtgaagagtggcttaattcacaccattaacatgtaaacatgttacatgttacaaacatgctcctcatgtaatccttatactaaagtttgagatttactggtatcaacagacatttaaggctaggaactgactgtaccaagatgttagaagtttaagtaatactgaccccccaa

SEQ ID NO: 11202 - DNA, 343 bp, Homo sapiens
atagtacatgattccccagcttcaataatggactaatgacccccggaatcccaccgctatagcctgcacttccccaggaattcctgtttaaggcgtctctcaatgaagaccacaaacaggaaatggaggagtggggagttgcctgacatcctggaaactacgttcttaaagaactgcaggcaatgggcgagagttctaatacatggaacagttacaggacactaagttctagagcaattcatctccagaacaaaaactgaaatggaagcaagaaaaaaataaggtaggccactcctttcctttaaagaccttttatagagtagcatccctttgctagcagtac

SEQ ID NO: 11203 - DNA, 400 bp, Homo sapiens
accgctatagcctgcacttccccaggaattcctgtttaaggcgtctctcaatgaagaccacaaacaggaaatggaggagtggggagttgcctgacatcctggaaactacgttcttaaagaactgcaggtgggagtaagtgggatagaaaaatgggcttttcaaaaactgttgagaacacggactgagtcagttgtatccgcacggctggaagacaggcagctccacctaacctcactcacttactcaggaccaaaaccctacttgctctgcccaagataaagcctgcagcatttgtacctattctacagggaacaccctccattatctttatcttacgctacacctcccttgagtaagccaagtacctatgactaaaaaagaacatgtaagaaaggtgga

SEQ ID NO: 11204 - DNA, 1842 bp, Homo sapiens
aatgtcctgagtgcgggaaagccttcagtgagaagtcacgcctaagaaaacatcagagaactcacacgggagagaaaccatacaaatgtgatggatgtgataaagctttcagtgcaaagtcaggcctaagaatacaccagagaacccacacaggggagaaaccattcgaatgtcatgaatgtgggaaatcttttaactataagtcaatcctcatagtgcatcagagaactcacacaggggagaaaccttttgaatgtaatgaatgcgggaaatctttcagccatatgtcaggcctaaggaatcaccgaagaactcacacaggggaaagaccatataaatgtgatgaatgtgggaaagctttcaaactgaagtcaggcctgaggaaacatcatagaacacacacaggggagaagccctacaaatgtaatcagtgtggaaaagctttcggtcagaaatcacaactcagaggacatcatagaattcacacaggggaaaaaccctataaatgtaatcattgtggggaagctttcagtcagaaatcaaacctcagagtacatcacagaactcatactggggagaaaccctatcaatgtgaggagtgtggaaaacattcaggcagaaatcaaatctcagagggcatcagagaactcacactggggagaagccctatgaatgtaatgaatgtggaaaagctttcagtgagaagtcagtcctaagaaaacatcagcgaactcacaccggggagaaaccatataattgtaatcagtgtggggaagctttcagtcagaaatccaatctcagagtacatcagagaactcacacaggggagaaaccctataaatgtgataaatgtgggagaactttcagtcaaaaatcaagccttagagaacatcagaaagcccacccaggggattaaatgtatgcatataaagaatacgaaaaaactctgagctggaaatcaaacctcacaatacataaatgaacacacaggagagaactgttaacatagtgagcactggaatttcctctacaatttcagcctccaccaaatatcaaagaatagaagataaattgttgaaatctattttatatgggcattctttcagccagagcccagtcttctatggatatacagaactcacacagcaaagaaaccctataaacataatgaatatggaaaatactcttgcgaactcactcctcagaaaactcacgctgcagaaaagctctgagaaagtaataaaaatgtgaaaactttgtgccaacaatcaaaactcattcaccatcagagaaatcacacaatgacaaaagctagaatataataagtgtgtgataaactttaatgaaaagtcagtacagcagaaaatacattcaagatagagacctcatagtatattaaaacaaacaagaaatgaagttaatggatgtgggaaattcttctgccatgtcaaccctcattttaacctacacagaggtaatccctatatgtcgtataataactattgaaatgttcactagtaatcattttcacttctccctcatgccacacctggcctaaatttctcaaccactctctcatctaaacggggtcatattgttaccctctagctagtggaatatggggtcagtgacaggtcttaaatacatcagtcaaattctcaatattttcttctatccctcattagaatggaatggaggaaaaccttgggactcaggctctgatgatggaaagtacaagatggtaggaacccgggtcagagaaggatcctgtggcatggagttttctcctccctgtacacagttggacttcttgcagtgaggaaataaatgtgttccctgctg

SEQ ID NO: 11205 - DNA, 467 bp, Homo sapiens
gatatcaatttattgggctatgtctacaatattatgacatttcaaagattaaagaggctcagagtaaacacaattgtgttaggtttcaactcgattccacaaatattgttcacatttataacacaggtcctggcatatagtaaaagtgggcgagaccagctcagttatataagattgtgggccaggcgcggtggctcacacctgtaatcccagcacattgagaggctgaggtgagtggatcacctgaggtcaggagttcgagaccagcctggccaacatggcaaaatcccatctctactaaaaataccaaaaattagccaggcatggtgcctcgtgcctgtagtcccagctacttgggaggctgagacatgagattcgcttgaacctgggaggcagaggttgccgtgagccaacagtacgccactgcactccagcctgggtgacaaagtgagactctgtctccaaaa

SEQ ID NO: 11206 - DNA, 316 bp, Homo sapiens
gacatgaacagacacttctcaaaagaagacatttatgcagccaaaaaacacatgaaaaatgccttccctctcctttcacaggcccccccttcagcattgacgtcattcagtcatcaaagggacctgtaagacgatctgcctgttctcctgtgaacaatggttaagaacgcattcaaggggtttccagggggatgaggctgggtgtggcagagagggcttgggatcattatttaaatcgcttggcaggaacactggtccattttccttttgtgatatgccaagggaaagggtctgggacaccagaggtccctcattc

SEQ ID NO: 11207 - DNA, 403 bp, Homo sapiens
agatcacaacactgcactccagcctgggcgacaagagcaaaactccatctcaaaaaaaaaaaaaaaaaaaggaaaagaaaaagaaataaaaaactcaaggcaaagaaaaggtttttagtttgttcccctaccactgatgtgaaatggggacctaggggagatgtggaaggatgactaaaatctaacacattgcccaccatttttgaacttgaaggttgagtttgcaaatcatttaccgcctttgcctacctcatctgctagttgccttctggaaattttgcagttccccctcaagtctagttatttgattctaactttggtacaagatttctggttggagaaaatgagatgtaactgaaatttccaggctaccattcattcattcactttagatacagggtct

SEQ ID NO: 11208 - DNA, 290 bp, Homo sapiens
ggaatgcaggcaagttaagatcacccttgagaggtggttctcagatggagctgtgccgccttcctagctgaggacctacagcgttgttgcagtgtagactcatgtaatggtgccatcttttaagcaagtcttgacttttgatgcctcatttgctgctgctagacccaggcggagcaagcttctctggcatgtgggtcgtttgtttgcagtgtgcatttggtgaaattgacagctgggtttccctgtcccccgtccccgcctggaacatcactgttctgagcctgtagcca

SEQ ID NO: 11209 - DNA, 354 bp, Homo sapiens
aacttttattttaggttcagagatacatgtgcaggttcgttagacaggtaaattgtgtgtcgcgggggtttggtgtgcagatttcatcaccccagttaataagcctagtactgatatgtagttttttaatcctctccctcctcccactctccaccctcaagtaggcgtcagtgtctgttgttcctttcattatacaaagtatttttgatattttaaaattacattaagaaaaatctctaatacttctacctagagatgaaaacatctgaataagtattatgaaagagaacctgaagtcatggttaggttaataagttcaactgcttgttcatgtattgagtcttcaccagagga

SEQ ID NO: 11210 - DNA, 303 bp, Homo sapiens
ggcattatatataaaaaaaaaaaacaaaagaagactctgaaaggtggagagaaggcagaccagctagggagctcaggaccaaagaaacaacacagtagttgattccctgggctttctttttgcctcatagatcccagatttggaactgaaggagccacggcacaccagtgggtgctaaaaacagctgcaaccaaagtctgctctctccagctgaaggaacaggaaaaggaaagcctagctagacagaaaactttcacacaataactactctagccaaatatcactggaaaaaaagtacagccc

SEQ ID NO: 11211 - DNA, 150 bp, Homo sapiens
ttttctttttaagttttaccaaaataattccaagtgggatgggaaggcagcctggcagaggccagagcaaccaggagggtgcacaggtgggatggcaacctgatgatgacatcaggagatttgatacatacagggaattaagcagaaaag

SEQ ID NO: 11212 - DNA, 343 bp, Homo sapiens
tgagatggagtttcactcttgtctcccaggctggagtgcaatggtgcaatcttggctcactgcaacctctgcctcccgggttcaagcaatcctcctgcctcagcctcctgagtagctgagattacaggtatgcaccaccacacccagcaaatttttgtctctttaatagagacagggtttcaccatgttggctaagctggtctcgaactcctgacctcaggtgatccacccactttggcctcccaaagtgctgggattacaggcatgagccaccgtgcccagctggggtttcacgtttcttttaaaggattatttttaaaaggctggtcactatgtactaagc

SEQ ID NO: 11213 - DNA, 281 bp, Homo sapiens
tgtctgtatagggctcctcactgttggtgtgtctggtttccaggaggcaggcgtgctgtctgaagaggctttggaagtaccccaaataattcagttcttgacctgccccagggccacacacatgcatatgctctctctgtctctctgtctgtctgtctctctctctctctgtctctggatttctcagagtgtgtatgtgtttttaatttccccgatgctgcagaccttcttaggttccaccagaccatctgttgctgtcatttcagcttggagtgcagtgg

SEQ ID NO: 11214 - DNA, 755 bp, Homo sapiens
ccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaatttttttttttaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcagcaatcaatcacgtactcaagcatacttctcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtc

SEQ ID NO: 11215 - DNA, 456 bp, Homo sapiens
cacaccaacaattatatcgcagtctgcaaatagctatattttgcttgggcaacaaagccgaggaagcctcagtttgtaatttaaccgaaaacagttttcaaaaagcacatccagtagaaatatccttggcttcttaccttctttctccatcaaggtgaacacttttcattacacctagaaatagccaaacagccagtaaaaaatcactggccagtacaaattcttaggcaataggaactaaccagatgttttatcagccaatcagaatgctgtaaaataacctgagaaaggctggcactgaagacgtttgtggcaatccagtgcctagcacagaagatacttgtgtgtattgcatcaactgctcccagttctccatagcagtggaggagaagtcagagagagaagagagagaccagcttctagacttccctactgccctactggctggttgcatta

SEQ ID NO: 11216 - DNA, 491 bp, Homo sapiens
gttctggtttctctagatttcacctgtaggtgcataagtagtggtcttttgcattataatgtacctagtgggaatgatacaaacagcccttatgaactgtaaatttaatcttacctgaaaagttggctttagagttatctacacagatatttgggtatgtgggtgattttttaaaatcaagttaactattaaaaaccaagttgaaattatcttttattttcagtatcagattaaggcgttaacatttaatgtacttccctgctaagtcctctgataaacatttattgtggggtgtttaccgcagagcctggcttatggtaaagattaggaaaagcttggtgaatgcctccttcacaaaaaagtcatgggaatgttgggcgcagtggctcacaactataatcccagcactttggaatgccaaggcaggaggatcacttgaggcttggagtttaaaaccagcctgggcaacatagtaagcgcctgtctctaca

SEQ ID NO: 11217 - DNA, 279 bp, Homo sapiens
ttcgttttgcctcctgagctgtgattcttatttctcttggtctgcacatccgtcctgcccttgatgttccctgacatcgggttgcctgagatgtcagaattgtaaagttcaaccaatgacggggaaagttcagagggagttttaagttcccctgccccttcactcaggaaaagaatcttactctgaattccatctacaaccccaccaggcagttatttgcctgatttggtctcatcttcagtttgcatcaagttgaaaacagcctgttggaaagccacc

SEQ ID NO: 11218 - DNA, 399 bp, Homo sapiens
aactgcaccctctaatagtagacgtccaacggagtatccattgcaccacagagccgacttggaccttctactattagaaagtaatcacaacagaaacttgaaattaataataacaattgttaacattttagcaacttcacattaaaagtcatagtaattactaactttgattgagagcttactatgtgccaagcactgttctccatacttcacacaaactttaatttgttccttacatttttccttttagataggtactattattatcaccattttacagataagaaaatggagaaagatattaataactttcctagcagcatattgacaataaaaagtaaaacagaaattcaaacctaggcaatttcatagactgaaactcatagtaatgtgtacagt

SEQ ID NO: 11219 - DNA, 651 bp, Homo sapiens
tcaggcttgatagtttctattttcccatcttcaacttcagagattctccttttataactggtcacctatgtctttgaatttctcttgtaattttttttcagttattgaaattttcagctccgtaatttgtttatttttaggtttgctatttattgatatttatactttgttcatacatatttttttaactttctccacatcttcctaaagatgagtatctttaagaccatggttttaaagtctttgtcaggtaaatctgccattagttctttttagggacagtttctgttgactcatttttatatatctgaatgtgccatactaccttctttctttatatgctttatgattttttgttgttgaaaattggacatttgtatctaataatgtggtaactttggaaatctttcccatacttagtttgatgtttttgtttattggtttttaaaaattgtttaggctgtttctgtgccatggatcagcctgagagttaaacttaggccctcctcaggtcttttctgagcctgtgtttttgcctgggcatgtgctgtcactttctaattttccaagatatacaattatttttgaatgtgctagttattaatgcttggcttccaaaagggagaaaaaaagaaaaataaaaaggttgtg

SEQ ID NO: 11220 - DNA, 295 bp, Homo sapiens
cacaggtttaaatggtttctgtttccctggtttgttctggctgtctgacagatatgttacaagcaatgctgtaatttctgaaataaagatgaaatgtatacatggtagtatctgttttatagtcataatgacagtaaataaatggaaaaatgtagttttacatgccttggtcttagaggatctatgcaagtttctagtaatcagttaaatcttttaggactgctttcaattcatctgttaaattgcctgaaaaggaatagcaggttaacgagtttgtaatccccaggagcttccc

SEQ ID NO: 11221 - DNA, 166 bp, Homo sapiens
tctgatagggataattttgtcaactccacctttctttctctctaatcctctttcatagcatgtgtatttgtgtctagatttagtttgggatggggagggaggacatagtactattacatgatatcatcgtggctctgaaggtatctcaaatcctgactatgccaca

SEQ ID NO: 11222 - DNA, 245 bp, Homo sapiens
gggtatagaaaataataaaaatgatacagcagattttaaaatttgaatttacagagacaaaaaattaagtgattgaaatttaaaacttagtgggtatattaagcattaggcatggttaatgagagaattaatgaactggaagacagggctggagaaattatgcagaatgcagcacatgagatgaaaaatataaaaggggcataacaagatacaaaagacagaattaaaaagtctcacatttgtct

SEQ ID NO: 11223 - DNA, 375 bp, Homo sapiens
gtaaaggggtgcttcttgccactaccacttatgtagagttgcatatatacattgaaagggtattcagtaccaccattcattcagtcaagctaaatacaggccagtagaagcagtattgttaatgcatgtttttgccttcattggcccaaggcctacttaacatttttgacacccatcacagcaatttatctttcagagataaaaaaaaaaatagcagattattatcacatatttttaaaaagaacattagaatttttggtaaaataagtagtaagacagtatcttgactctgctgcatacttgcttttgctggatgactaaatgagggtgaaaaatttaaggttggtttatgactaagaaggtattaaatgatag

SEQ ID NO: 11224 - DNA, 357 bp, Homo sapiens
tttatcattgcactggatgtacagttccattcagtctgtctttttattacaggtaaagatggaataattaccatccattgatatgaccatagaccagaacaaactaaaaagaagaagaaagataaaagattgtacaattgctctctggtgtcaacaataatcattggagaacatactattttggggcctggtatttaatagctacatggacaagaatgaaataaagtctacttatttctatttcacattgttgggtcatataatagcatgacctagggttaatagggaccttagattaatctatggctccatgataattcacctaaatcaatctactgactcacaaaaaacaaagca

SEQ ID NO: 11225 - DNA, 696 bp, Homo sapiens
  misc_feature (7)..(7): n is a, c, g, or t
  misc_feature (40)..(40): n is a, c, g, or t
gatcctnatgatatttggcagctgtcctccagtcttaaanggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtaaaaaaaaaaaaaaaaaaaaaaaaacaaaacttgttgtgggccgggcgtggggccctttggaaaaaaagcttttttaagaaccactgtggtgttgtgggagcggcgggggccccagaatagtggtatagagtgaaacagtgggtcaattagcgtgtgtttcctagaggaaaatctcgggggtaaatgaaaacaagaggtgggggtggggaaattatctcataaacacataataaaaaaaggcgccgcgggggggtgcgaaccaccgcagagagagtttgtttttctgagaaccaaaaatctctcccaaaatattgcaggaggctcctcagagaagcgggctacatctctacggggggaggatctcttatctacagcacggggaggggtctacaagagcgcgaaacatgtctagcaaattcttaataaaatctttccccccccgcggccctcggg

SEQ ID NO: 11226 - DNA, 297 bp, Homo sapiens
  misc_feature (7)..(7): n is a, c, g, or t
  misc_feature (40)..(40): n is a, c, g, or t
gatcctnatgatatttggcagctgtcctccagtcttaaanggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagata

SEQ ID NO: 11227 - DNA, 185 bp, Homo sapiens
agaaaaggaagccataaaaacatgatcagtacagtctccaattaaaagaaaaaatcatgacaaaatacttgaaaatgttacagtggttatctagtggtagggcttatagcttattgaaattccttgccttttgtcactctgaattttataaatggtctataatgaacatgtgttatatctatgat

SEQ ID NO: 11228 - DNA, 295 bp, Homo sapiens
agtcttctgtttccactagggcttcagcattgccgaggagatccttccagcttccccgactgctcctttccttattctcaggaagactgacctgacccttctccagtctcccagcctctgaatgctgcccccaccccttcccactccatgtagataaccccacctcccacttctctggagtatggaagaggtcagagggatcacccccgtcttccccaacaacaagcctacccatgatagacagcagctgcaagggcctgccctcccttctccacttggcacggagcagttcccc

SEQ ID NO: 11229 - DNA, 390 bp, Homo sapiens
gaaaatttttctcttagggaactagctttcagtcctttagtaaatgcaaggttaagattcaaaccctaatttgtctgattctaaagaccacgcttattcccttgtacttgccttctaatttatactcaaaccctatgaatttccttaaaaatatctcttactccttttttcctcaaacttaccaacactgtcctactacagtgccccattatttcatctggtttcccttttgcctttatcctcaactttgccactagaattatcttcctaaaaactcaaagttacacatatcattctatattcaaaagctttaacactttctcatgccaacagaataaatttctaactccttcacattttatttgaggcccctgccatgtggccctgacc

SEQ ID NO: 11230 - DNA, 850 bp, Homo sapiens
ctcagccacctgctcagaaaataaacctctgggtaggcttgcttggtccacacgcccacccttctgaccaaacacgactgcagagggatggacaccacatgggggccgtgcgcagcatgtggctgagcttgtatttgggatgtgacccacagccctattggctcagcatgcgagagagcagggatggtgctccccaaggaaggactggtgggcaggacggagcagcgcatgtccactagggttgaaagtgctctgcacggcaccagttgcctggtacccatttcataaactgtggccaccatgattgcttcagctcaataagtggtggttagtattaacaattacttttttcacttattagttgattacttatttattgaggtgcttttgtataaaagattcaagctttctgaaatcgaagttaaaattttgtaaacatatcccacgccattgaacctttgtcagtcatgtcaataaatcacgcccttagatttaggttgagctccctctaccctattggcaacttctgcccacttgaacaccactccaaggtcatctgatggcacattagtcatggagttatttatttttcctccagattataaagtccttgagggcatatgctcttgactggcttaagagtactgcatgcctctgtttcccatgaaagctaaagctagggtaggcccatttgctaaaatgaagtatggctcagtgtggcggtgcacacctatagtcccagctgctcaggaggcaaaggtgggaggatcgcttgagcccatgagttggaagctgcagtgagctatgatcgtactgctacactccagcctgggtaactgggtgagaccaa

SEQ ID NO: 11231 - DNA, 408 bp, Homo sapiens
tctcgacagtggggaggctgagacaggagaattccttgaacccaggaggtggaagttgcagtgagctaagatcacgccactgcactccagcctgggtgacagaagaagactctgtctcaaaaaaatatatatcatatttggcccagatctatgttttttgcctccaacaagttttcatgaggttaagttaaatgtgggaatttatttcagacagtctgcaaagtggatagctcactagagcaaacatacaatcacctgcaggctgactgtagtcaaaataatctactgtcactctgaataggttttctcacataacatctacaaaaacccagcataccattgtcacacccacatggtgccttctgatatgtgacattagaaaacctcaatctcctaaaaaaaatcata

SEQ ID NO: 11232 - DNA, 349 bp, Homo sapiens
gctcaaaggaactaagacaaaggtcatggagaccatagggtgagtctcaagacttcccccagctctacttggctggtctcctgctggtattttccgtctgtagagaggaaaaagaactcccattttatcttgcttacctgcacttatgaaaagtcaaactgagtcatgttgagagccagggaacataggagtcggttcttcagcaggagcactcagctagttgaaggcaatgtggagtgatgggaagagagcagtgatgcagtgatgctgccatcaactcctttactatggaatccattgtaccagctgccatacacctggctacttctacaccttatctctaatcact

SEQ ID NO: 11233 - DNA, 2496 bp, Homo sapiens
tgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatctttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcaaaaaaaaaaa

SEQ ID NO: 11234 - DNA, 928 bp, Homo sapiens
tccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacagatttttgatctatggcaaatttctcaaccattccagccctaggtcac

SEQ ID NO: 11235 - DNA, 2674 bp, Homo sapiens
gagacggagttttgcactgtcgcccaggctggagtgcaattgcgtgatctcggctcaccgcaagctccgccttctgggttcatgccattctcctgcctcagcctcctgagtagctgggactaaaggcacctgccaccacgcccggctaatgttttttgttgttgttgtttagtagagacggggtttcaccgtgttagccaggatggtctccatctcctgacctcgtgatccgcccgcctcggcctcccaaagtgctgggtttacaggcgtgagccaccgcacccagcctgcctgcttattcttatccaaatatttgagagattctcttcttctaactcccagtaaaccacgctggaagtagtggagtaatatatatactaattataactatatataaaactgatataattagggtatgggatggatgttcatactatttccatgaaacttactttttttcttactgccttttcaggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatctttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcaaaaaaaaaaa

SEQ ID NO: 11236 - DNA, 2924 bp, Homo sapiens
tccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcaggtaacctgctctggcttcagcagcgcccagaggctttccagagagctgataaccacgaacaaacttggctgtcaaaagcaaatcaatgctttaccttgttttctgggtgcctagtctatccaacacaaactatccccgaagtttagtcaggatttacgctaaatatattacttatatagacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaacttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatctttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcaaaaaaaaaaa

SEQ ID NO: 11237 - DNA, 2616 bp, Homo sapiens
tccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcagctgttggagtcctgtacatagaatggctggatgcctttggtgaaggaaaaggaaaaacagcctgggttggatccctggcaagtggagttggcttgcttgcaacttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatctttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcaaaaaaaaaaa

SEQ ID NO: 11238 - DNA, 2746 bp, Homo sapiens
tccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaacttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatctttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcaaaaaaaaaaa

SEQ ID NO: 11239 - DNA, 2619 bp, Homo sapiens
gagacggagttttgcactgtcgcccaggctggagtgcaattgcgtgatctcggctcaccgcaagctccgccttctgggttcatgccattctcctgcctcagcctcctgagtagctgggactaaaggcacctgccaccacgcccggctaatgttttttgttgttgttgtttagtagagacggggtttcaccgtgttagccaggatggtctccatctcctgacctcgtgatccgcccgcctcggcctcccaaagtgctgggtttacaggcgtgagccaccgcacccagcctgcctgcttattcttatccaaatatttgagagattctcttcttctaactcccagtaaaccacgctggaagtagtggagtaatatatatactaattataactatatataaaactgatataattagggtatgggatggatgttcatactatttccatgaaacttactttttttcttactgccttttcaggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagctttatgtagtgtatgcgtagcctctatctcgtatctttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcaaaaaaaaaaa

SEQ ID NO: 11240 - DNA, 2295 bp, Homo sapiens
tccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaatgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcaaaaaaaaaaa

SEQ ID NO: 11241 - DNA, 798 bp, Homo sapiens
tccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacagatttttgatctatggcaaatttctcaaccattccagccctaggtcac

SEQ ID NO: 11242 - DNA, 341 bp, Homo sapiens
tttaccttgttttctgggtgcctagtctatccaacacaaactatccccgaagtttagtcaggatttacgctaaatatattacttatatagtaagttattcgatataacatttttggtcaattttctaggctacagttttgatgtgttttttaaaaatcttgaattaactgaataacagttcatattgaaggtggattctcccattccctgcacccaggattttccgttgttccatcaaattctgtaaatcggtatgccctaacagtttcttatatttgagttggcttcagcttcgagaaattcttcaggcaggtttaggcagagggctgaggaagctagag

SEQ ID NO: 11243 - DNA, 337 bp, Homo sapiens
cggccgcgatccccaccacaccaccagcccggccgcacggggcactgagccgggtgctgagcaccggaggccccgccgaggccgggactcaggtaaagggctggagcttgcggggagggttccaaaggtgggcagcagcccctgctgcccagcgtcctagaggcaagaagtaactccgactcggagcagtaggagggggcggtggagcagcatggaaccgggcttttgtctggggtgtgtgccgggggcttcgagtgtccacggtgcgcccgcccctcgccgccccctttttgatggggtgcttctacaaagtgggcaagttttcccgggaatccga

SEQ ID NO: 11244 - DNA, 433 bp, Homo sapiens
tcaatcactttgtcctctcctacccactcacatccttaccttgagcttaattgagagaaaaagatgaaagcataaaactttgtggagtgaaaaattaggcaaccaaaatagcatcttatgaagggtaactcatggtggatgtgacaaagaaaagatgataaacctataaagggctaccatcctaatatttcagaacaggcttcccggtgataagcgattatatttcaaagagataagatgtgatgcatattctctttatcatgaaaatgtgaaactgtatcttcttgaaactgaaaataaagatgtatactgactatatggctatgtaatggttattaattatacagttttattttgcttatgagtctgaaaaatatgtgtacaagtgaaaataaattgataagaatgcaagttattttacgtaaaaaaaaga

SEQ ID NO: 11245 - DNA, 467 bp, Homo sapiens
aatagagtctccaaaacaaggtttagtattcatggtgataccaggcatctggtcattttctccaatttaatgaaaattacttggtgtaatgtttactctaggtcctgagataaatagattttgtagctcagttgtcctcagttcttgtttaacttttttttttattagaaatatctgctaaatatagtcagatgcctttttggctcattgatatgatgtttttctccttgagtttgttaatgtgacaagttgtactgtagtcattaaggcaggtatgttagaatgaaccagaatgttcgatgagcaagaatgaacaaatagaccaatggaacaaaataaagagccctgaagtagatctctctctatatatatatgtggttgtctaatttgtgataaagtttcctcggccatgtggttgggaaatggtggtcttttcaataaaaagcactggatcagttgtgtatctg

SEQ ID NO: 11246 - DNA, 425 bp, Homo sapiens
gccgcgacggtattgaaggagttgccagcaaggaagtgtggatttattggtaattgttttattgttgttgctttggttaaaatcctgtcttaagaaacattgttttactcttcagttttcataatcattcttcttatgtatgattgaacatctacaaatttcctcctctgatcttccgatcaaatggtaaaattgccatcttttcagaacagttatcaggattcgacatcggaaattgattttcaacctttggcattttctgagtgacttagggtagggagagacctccctctaacacccgggtttgtgtgggctgcagaaagctgctggtctaatcctagatgcagacattgaccaggctgtgcctgggtttgggttttgtagggtcagaaatatgtttaagagttttttccgttcataaagag

SEQ ID NO: 11247 - DNA, 193 bp, Homo sapiens
agtcaccaagtccttagaatttatcctgctctactgcatgtttcttcctcaaaccgtccttcacctctgtactgcagcccctttagaaattagcttgagaggccagatgtggtggctcaaacctgtaatcccagcactttgggaggccgagacgggcagatcacctgaggtcaggagtttgagaccagcctgg

SEQ ID NO: 11248 - DNA, 1028 bp, Homo sapiens
  misc_feature (418)..(418): n is a, c, g, or t
  misc_feature (422)..(422): n is a, c, g, or t
  misc_feature (426)..(428): n is a, c, g, or t
  misc_feature (430)..(430): n is a, c, g, or t
  misc_feature (432)..(432): n is a, c, g, or t
  misc_feature (437)..(437): n is a, c, g, or t
  misc_feature (439)..(439): n is a, c, g, or t
  misc_feature (441)..(443): n is a, c, g, or t
  misc_feature (1018)..(1019): n is a, c, g, or t
gcttggtaaatgggtaatgcccttgattccttgactgtaggacatagctgatctaaagtactctgtcagttttaccttcacccatgactgtcattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagccttttggacaaattnactnaatnnnantntatanantnnnattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccacgacacttagtaaatgcaagctaaaatgtaataataataaattgtattggagaaacctaaaaaaaaanntttttaaaa

SEQ ID NO: 11249 - DNA, 831 bp, Homo sapiens
  misc_feature (216)..(216): n is a, c, g, or t
  misc_feature (233)..(233): n is a, c, g, or t
  misc_feature (236)..(236): n is a, c, g, or t
  misc_feature (260)..(260): n is a, c, g, or t
  misc_feature (821)..(822): n is a, c, g, or t
ttgggagacccagtggttaccaaatccctaacagagaaagcagtaaaatggtccacagcaggttgaacggtcatagagaacatctcattaaactacattatatttttgagaataacaccatttctgccctaattggttaattaatatcacatctcctgtgataaacgtgccattgaaagttttttttattggtacttttctaggtgtcgcacctcnttcttttgtagccattnagncaggaacaacactgtatcaacttncaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccacgacacttagtaaatgcaagctaaaatgtaataataataaattgtattggagaaacctaaaaaaaaanntttttaaaa

SEQ ID NO: 11250 - DNA, 391 bp, Homo sapiens
ggtcacttgactggaattagaattctcttttgatgagtcttttttatattctgtctgggattgtatgtaaacttatctttcctttctaaagaacctcaacatgctaaaatttaaatgcagggttccaattcaaataaagcgtaaggaataaaaccgtttcccttttaaaaaatgtgtgaaattttaagtgggcttttttggggtttttgttttttcctaagttacttttcaaagtggaatacctttatacggacacgtgtaatcaaacatcattatttatatttacattctctttggaaaccatgggattctcaaggcccaaagccaagtgcccaagaaccctgaccgaaagtgtgtggttgcctattgagggagcaattgctatattata

SEQ ID NO: 11251 - DNA, 456 bp, Homo sapiens
agcattttctcttagacaaagtatataaagcctcttactcttggaatgaccttcattagtttctttcctgtttggtgagcttcatatttgcagagatcttgaaaattagtaagggcatataagaaagaaaaatatctcaaaattatggacagaattacaatataatctgacaggccaaagtcacactaatatttagggaacaagctgccttgattatttattcccttcgacttttaaatactcttcaattttacactaataaaacattttttggaagatagtatttgccttgtattttataagtaatgtagaacaagaaggaaagaaaaatgagggggttattttttcactgtacagggtcagtgtgatcagtcacatttatagggcagaagcaatatagagactataaaatgtaacagtgtttcactctatctgcataattactcagttactccc

SEQ ID NO: 11252 - DNA, 454 bp, Homo sapiens
ctctatgttcctgaatactttacttctctcacgcttccactccaaggcgcatacccaggctcatccattcacctcacgtacaaaatgaagagggcaattttctgtagtaaagatatatgggagaagccaacctcaagttcacatctgttaaagcatttctctgttggcaacatttttacaagcctctcaaagctatatgcttaattaaaataaaagggtgatatacatcattgcaccaagtctttgctgatatagaggaaggaaggggaaaaatgagcgcattagttctcttttattaaaagagttatttcagcatgacatctcaactaaagactagccattagcaaaattaaaaattaggtgatgttgattttgggaaatgtacacatttaatgccttcctctttcctccggctgcatctcctgtcccggctccaagctgcttactttcctcc

SEQ ID NO: 11253 - DNA, 262 bp, Homo sapiens
ctagagtgcagtggtacaatcatacttcactgcagcctccaaatcctgggctcaagtgatcctcccgcctcagcgtcccaagtagctgggaatacaggtacacatcaccgcacctgaatatttttttgtttttgtagagctgagctttcactgtgttactcaggctggtctcaaatcccgaccttaagcagtcctcctgccttggcctcccaaaccactgggattacaggtgtgagccaccacacctggcctcaatctgttt

SEQ ID NO: 11254 - DNA, 358 bp, Homo sapiens
aaataaatgtctttgttatctcgcttctatctccgtgcatatttgtttcatatattttattcatattttggttgtttcaggcaggaaggtaaatccagtccttgttaactccattttgaccagaatgtaacaaaaacaggtggcacaagtaggttgaataaaagacaacatttttgcttccaacaagaaacacccttgaaatataaagcacaaataggttgaaagaaaatggatggggaaagatacatcatgccaacaggaatcaaaacaagtctggagtggttacattagtaccaaagtagatttcagaacaaagcacattgccaggaataaagtgcatcattttaaaagtgtcgaa

SEQ ID NO: 11255 - DNA, 710 bp, Homo sapiens
ttccctgcctcttccagctcctagagaccacctccatctgtggcttgtggcgcctttcgccatctgcaagggcagcagcgtagcagcttccactttcctctctctgcttcctttgtcacgctgccctcttctcgctctctacctcctgccttcctcctacgaggacccttgtgatgacatgggcccacccaggttatccaggataatctctcatttcaggacccttaattcagtcacttctgcaaagtcccttttgccatgtaaggtagcatgttcacaggctctgggggttaggatgtcaacatctttgggggattattcttcagcctaccacacagcacataataaaatccatgggcagaggggatagcagcagtaaggtgtccctcaaacatgagttaaaatgactctgacgatagaatctgggtgagatggtgggatgctcccgaaataaactccaaggcaggtggccaagttcagtgacgacatagctgcgtagcttatctgagaaaggatgtctctgatggggggccagccggaagacgtctttcctggaagaggagggaggtggggcagtcttgggagaagtgagactttgggtcccacggccagctcctgccacattctcagtggatttcaggttgggaggagggataccattacagttgtacagttctggaagacggtccaggcccacatccccttctctg

SEQ ID NO: 11256 - DNA, 309 bp, Homo sapiens
cttttctacattacggtttcatgtgaccaaattatggccatagtatttcagatttattcatccactaagtatttattaagtacctattctgtgctaggtatcaggtgctggggctatagcagtaaggaaagtaagtggacaaaaggattccacacctgtcacaggcgctgccccactccctgagtcaggtgagatgagctccggaaggcaggtgggtaatggatgatgctcacctagtgttccttgggccatgaagatcaaatatttcagccccataggatgtgtaagcttgatttctggtcatctctc

SEQ ID NO: 11257 - DNA, 915 bp, Homo sapiens
gcacacatggccccttctctggaagcctctatatttaaacacgtgtggccccccgtctggaagcctttatactgaaacacacgtgaccggctgtctggaaagtgagctgggcgccgtcactgatgatgtcttttctgtgggacacagtcaggcacaccccttgcccttctgagcctgggacgagacagagctgacaggcggagcccaaaggtgtgccgagcaccagtgctgccaggggtgagagtcacatgcagctgtggctgccgtggacgcctgcttttttgccctctgcagtttgcctaacccctgcagtttgcaggcagccctgggcctctggacagagcagccctggttccctgtcagggtgagtgatccagaagaatctggcagcccgagccccgcgggtaaggagcagtcagcaccgtcaggaaccccgcggagggagcagccgtgcaggctggtgggcactgctttccagggaggcccacatctgtcactccagaagcacccaagtttactctgccacgtgaggacgctcatccctcggtcacatgaacctagaccttgcttcctttggaagctgcagtcgggtgtcctgaggcaaggtggccccacttccagctgctgtgcctggcacggcctctgaggcagatgggccgcccagcttgggtgcagtcggtcctctgttccctgcacctgtcgtggcctagactccaaaaaataaaaaattaggtgtggtggcacactcctgtcatcccagctattttgggaggtagaggcaggaggctcaggagttgggggctgcagtgagctgtgattgctccactgccctctagtttgtgcgacagagggagactttgcctcaaagaaacaaatgaaaaagagctgggagctcacagccctgccttaagagct

SEQ ID NO: 11258 - DNA, 368 bp, Homo sapiens
attcatgggtcaatcagccctgcttgaggcaaggcctgggttcagtggataaggttgcattttctgaagctcttagctggtgaggttcccccaaaattttcctttaaaaaacaaaaaagaggaatctatgtaatgtgagtctcccatcagtgctcatgcttttcttattcagctgagtttattattcaacattcacaaatttcatagtttgtggctatcattccccataaataattgaggctgtcatataattgatgagcttttacatttcaccattaacttactctctgatttctaaaccatcaggaatgtgcactttttctttcccaacacagtagttgatttgcttatgtttaatttcataaatc

SEQ ID NO: 11259 - DNA, 470 bp, Homo sapiens
ttggctcatgcaatgtgtcaagcaatgtatttgagattggaaaaagaaattagtagccatctgaaatcctggaaaccttgtctaacaccactatggtagatataagcagaaaaaagcttccccctgcctttttttttttaattgaaaacatgggaccttaatctagtgggggtaaaggaagaaaatgagggaagccagcaaagcaaacttcatggaatagctgccttctgagctttattttgagtaaatagtacattctactggtatagagtttttggaggaattttatgctttctgtgcccttaatttcttccttccttgcttgcttcctttctttttctttagtttttttctctctcttttttatcttcctcccttcctctcttcctcctcccttcccccactccttcctttttattctttgtctcattttctttcttttctccctttctcttttcctacctccctca

SEQ ID NO: 11260 - DNA, 167 bp, Homo sapiens
tattttttgttctctctattgtttttcttttccttgatgttccaaaactccttattttgttgtctttctcctggaaaagcctccttcagctatctttttaggggtatttgctgatgacaaattatcttagattttttttatatgagaatgtcttcatttgctcttca

SEQ ID NO: 11261 - DNA, 443 bp, Homo sapiens
cattatataaaccacagaatccaaaaaggacaatattgataaaaatttaacattttcatttgtaggatataccataaatagagttaaaatacaaatgaaaaactaaaaatctgtattatatgtcttaaaagattatattgtgaaatattaaaagttcttttagctgggcacagtggctcacacctgtaatcccagcactttgggaggccaaggcgggctgattgcttgagcccaggagttcggaccatcctaggcaacaccatgagaccccgtctctaccaaaataacaaatattagccagggacagtggcgcacgtctgtggtgccagctactcaggaggctgtggcaggaggatttttgagcctgggaggcagaggttgcagtgagctgagatcgtgcccctgaacttgagcctgggtgacacagtgagactctgtctcaa

SEQ ID NO: 11262 - DNA, 369 bp, Homo sapiens
cttggagccacagtaaggtataaaaagcgcaaagcccaaaatgcaggcggaaagatctcagagagggaacaagtgggttcccaaactgagccacatgtcagagtcaagaaagaaaatgcctctgcaagcaggcttgaatcaggccaacccaataaaggtgcgcagagtctcagtggaagtctttgagaagccaccgagtagagactcagtggaaatctgcccttccattgtgtcaagtcacaagcagtaaagagtctcaaggaggggcaactgttccaattcccagagttgctgagctcacagctaacggtggcatggaggagacgccatccaaagaatgttaaacattaagcctagtgcatcctcttc

SEQ ID NO: 11263 - DNA, 542 bp, Homo sapiens
ctggggacaggaagacacatagttcattttatagaaataaaagatacagtggcaaggaaacattttcatcccatttaacatatggcatttaatttggtaatagtcccgggcaagcacagggaaaggaaggagaaaggagggggtattgctgtctataccaaggcacagaactgctgctcacacttcagtgatccctgcagatgggaagtatgtgttcatggttattgtagaaacctccagaatctttctttgttacagctttaatagaattgttcctaagaggcgactcagaaaacatacagattgaatgccaagttgtggaagtcacttttcagcttgtgtctaacaacccagcattctcagcaaagcagtttcctcatgagaagagtggaggagaccttttttttaaaaaaattatttattgtatgttgttcgtatcctatacaccacacatgacttttactgtattggaaatgtattatttcagtggtaaatactgcatatcttactgaaaaattaaaaccttttaaaaaacaaaaaaa

SEQ ID NO: 11264 - DNA, 229 bp, Homo sapiens
gctcttgctaattttctaaccacagagttcttaagcctaatctctttaattagtggttagtcaccattgcatttcagtttgtgtagatttatttctgaggggaagcaaaacttcacgtgttggcttagtgtgtctattaccctgaattctagcgagaaagagcccagtgtcttccgctgcacacacctgggattcatcttaataggggtgggcaaactatagcctgcag

SEQ ID NO: 11265 - DNA, 736 bp, Homo sapiens
ggggaggaccccccaaaaagcagagcggggcctccagggccatcttctctatggcttgtgaaaactgagcccagtattcccaagtttatgatggattctcagatttctaccattttcagctaaattcacttacaagaaagtttaaaatcttgtttgtaatgatctattcactcaaaatactgaagtgaggaattcgataactgctaatatctggaattctaagatatttaaatctagcctggttctaaaagagtgtcaataaatagtaactacaacacttttatattgacttaaatacattttattggttaaactgcataaatacatatttgctaagcattggtctttcagtggtcagaatggatattttcctacaattttgatgcaataggaagcaaataaataccacttgctgcaaggctattgccattcgtgagaatgtttctgcagccctcaagcctggatacagattttataaatggaaatggtttatttggtaaatattctctgcttcttaccttctgcattggagcataaagaaatctgtttagtttctaataaccagaaattatacacatgcttgcatcaaatgtgtattggccaaacctcgtgggcaaatgtgtagggagatcacttgagttgggcattttgaggagaaagagcctccactgccatccctgggcattctctgcctcaattctcagctgtggagctcagccctctgctgggaaatcat

SEQ ID NO: 11266 - DNA, 323 bp, Homo sapiens
attgatttgaaaaactgctaatgttagtaattccttgtaatatatatgacaggtattccccccaacccccagtttgtcctttgtcttttaatttttgggtagtcaaatctatcagttgtttcgtttatatggaatgagcatgacagtgtgtaatagtatgatctctggaatcagacatgcctggattctaatcctgacttgactacctttttttccctttttctttttttttttttttttgagatagagtctcactcttgtcgcccaggctcgagtgcagtggcacggtctctgctcactgcatcctccgcctcccaggttcg

SEQ ID NO: 11267 - DNA, 1205 bp, Homo sapiens
tgacattgcttttggtgttttagacatgaagtccttgcccatgcctatgtcctgaatggtaatgcctaggttttcttctcgggtttttatggttttacgtctaacgtttaggtctttaatccatcttgaattaatttttgtataaggtgtaaggaaggcatcatctttgagatgaatgtgaatgatcgtggaatattccttctgtgacagactttatttttgagacaggatctcactctgtcatccatgctgctgtgcagtggtgcaatcacagctcagtgcagccttgaactcctgggctcaaggaacactcctagcctccccagcagctgggactacaggtacaggcgctgccatgcccggttattctggcttcaagcaattctcccacctcagcctcccaaagtgctggacttacaggcaggagccactgcgcccccggcccttgtgacagacttttaatgaaaccattatatttacttctttgacagcctgttactatgtcaattcctccagccactacaaaacctgtcctcatggtttagagcattggcagtcactccctaaattggagtggagtaggaaggcagtctgtaggaggggcttatggactccttaagggcataggctgttggagtccctgctgagagatctctgccctaccttgtggaactggagtgaaacaacgggggcgttgcttccagccatctgggagagaggatccagagcttcccctcagagagctgggatgttgtcagcaggcatcagacagagcaaaaagccatttttctttattctattcctgatacaaagcaactgagatatgcgtttctctttggaattgaggaagggagaataatggagcttttgcggtgatggacagggaaaaagtgggggagcagttaattatccatcttgacaggtgtagacacaggctgggaagctgggtgtgtcttaatccctgctcctgaaccaccgtggggagcaggaagcctacagtttccttatatcagcaaatgcatcatgttgaaacaattttactgcttgctttctgaatttaaatatagattttccctgagaagggctcaagcatgcagatggtaagaaaaacaacagtctagaaagatatcttcaagttccttctcctggttggtggaaatagagcaattcttttccaaaatataatttttagagttttaaagtaa

SEQ ID NO: 11268 - DNA, 704 bp, Homo sapiens
catttcttatggatgatgggagaagatggaattaaccccaggctgatattagttgacaacaaatatcagagtgcttgctctgtgctctagttaatttgtcagatttcacagggatttttggtacaagaaagctttgtggaatatatgcattctatgcgccaggcttagtgcaaggtattattagagaaaaaagacttaaaatagaaggtactctatagctatattagatcaggtcagcacttgggaaagttagcttatagacccagttttgccattaaatacagaacttcataaggttctatggcttctctgggcctcagcttcttcatcaataaaatgggcagaggtgaaccagacgacctctaaggttcctttagattctaaaatgatgtaatttttaaaacctttgaaatgtttattcaggtcttctctccttgaggtgttcttgggaccggagatattccatttgaaaccctgagacaaccatacctcaagctcagagtgcttaagaattttctgccaggtgcggtggctcacaccagtaatcccagcatttggggaggccaaggcgggcggatcacgaagtcaggagatcgagaccatcctggctaacatggtgaaaccccgtctctactaaaaatacaaaaaattagccgggcgtggtggcgggtgcctatagtcccagctacttgggaggctgaggc

SEQ ID NO: 11269 - DNA, 863 bp, Homo sapiens
ctgaggtcaggagctcgagaccagcctggccaacatagtgaaaccccatctctactaaaaatacaaaaattagctgggcgtggtggcaggcgcctgtaatcccagctactcgggaggctgaggcaggagaatcgcttgaacctgggaggcagaggttgcagtgagttgagatcacgcccattgtactccagcctgagggacaagagcgagactttatctcaaaataaataaataaataaataaataaataaagtgatgttttcttctctctctttttttttttggttagaaagctttaaacagatccacaaacatgtacaaacacatggatatacacactttaattataattagtttaatttttttgggttcaatttcagatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaaggtaaggcttttagaagaggaaagaaaaatgggaaataaataacattgctattgttagaatgagagatggccttagttcacttattttttaatgcttctttctggaatattcatacatatcttgacataaccaaatctatacaatatattgggaagtgagggtacagaaatttcttcttttaaaatattatttaatatactcgagtgtgtagacatgtttgcatttacatatggtattacacattg

SEQ ID NO: 11270 - DNA, 785 bp, Homo sapiens
tgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggttggtactcataatcaccatagatagccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccagaagaatgaatatgattggtctagtcaggaaatttgtggattcaatatgcaaacatggaccaaggcatagatgttgcaaacattatgaagataattgcatctcttattgcattaaagtaagtatatgaaagtatgtac

SEQ ID NO: 11271 - DNA, 3317 bp, Homo sapiens
tgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccagaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcattttggtttcagacttcaaagttgattaataaatttaatcttaactttttattcactggaatcaaaatgatggttggtactgtgtttactgtttaaaatgaagtactaaagccctgagaactgcacctcattttctttatccagaaattgtgcttatatattttcctgtcaggtttaaaaagatgttttaattcataaattattgttttcattgacattaaaagactgtgatattgaaagatgaattacgaaatttgctgagattgtttagtaaaattttgctggtcaaaaaggtgtatttctacaatttaccttttcatttttataaattgcagtcatttttttaaattttatgtaaaatgtaaaatgaaatagctatcatgaagcagaatacaatgatgaatgtataggttgagtgaataaccaatttgcagtggtggattgagaagtccagtttgatttcattgggacagactgcaaagtgtagttgtttgagcaaacacaaagaaactttgtgtttttgaagacaatcagaatgattacctttctacctctaactaatcaggtattgattgacaactttttggcattataaataaagtaaaatagatctctgcattcca

SEQ ID NO: 11272 - DNA, 3232 bp, Homo sapiens
tgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttggtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccagaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcattttggtttcagacttcaaagttgattaataaatttaatcttaactttttattcactggaatcaaaatgatggttggtactgtgtttactgtttaaaatgaagtactaaagccctgagaactgcacctcattttctttatccagaaattgtgcttatatattttcctgtcaggtttaaaaagatgttttaattcataaattattgttttcattgacattaaaagactgtgatattgaaagatgaattacgaaat

SEQ ID NO: 11273 - DNA, 3667 bp, Homo sapiens
tgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccagaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcattttggtttcagacttcaaagttgattaataaatttaatcttaactttttattcactggaatcaaaatgatggttggtactgtgtttactgtttaaaatgaagtactaaagccctgagaactgcacctcattttctttatccagaaattgtgcttatatattttcctgtcaggtttaaaaagatgttttaattcataaattattgttttcattgacattaaaagactgtgatattgaaagatgaattacgaaatttgctgagattgtttagtaaaattttgctggtcaaaaaggtgtatttctacaatttaccttttcatttttataaattgcagtcatttttttaaattttatgtaaaatgtaaaatgaaatagctatcatgaagcagaatacaatgatgaatgtataggttgagtgaataaccaatttgcagtggtggattgagaagtccagtttgatttcattgggacagactgcaaagtgtagttgtttgagcaaacacaaagaaactttgtgtttttgaagacaatcagaatgattacctttctacctctaactaatcaggtattgattgacaactttttggcattataaataaagtaaaatagatctctgcattcca

SEQ ID NO: 11274 - DNA, 3543 bp, Homo sapiens
tgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccagaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcattttggtttcagacttcaaagttgattaataaatttaatcttaactttttattcactggaatcaaaatgatggttggtactgtgtttactgtttaaaatgaagtactaaagccctgagaactgcacctcattttctttatccagaaattgtgcttatatattttcctgtcaggtttaaaaagatgttttaattcataaattattgttttcattgacattaaaagactgtgatattgaaagatgaattacgaaatttgctgagattgtttagtaaaattttgctggtcaaaaaggtgtatttctacaatttaccttttcatttttataaattgcagtcatttttttaaattttatgtaaaatgtaaaatgaaatagctatcatgaagcagaatacaatgatgaatgtataggttgagtgaataaccaatttgcagtggtggattgagaagtccagtttgatttcattgggacagactgcaaagtgtagttgtttgagcaaacacaaagaaactttgtgtttttgaagacaatcagaatgattacctttctacctctaactaatcaggtattgattgacaactttttggcattataaataaagtaaaatagatctctgcattccaaaatatgttttttagtttatttatatcctgaagaaatggtaagttttcactggaactgattacagtaaacaataatatgtccccttagtctttctgacatttttatatagattgagattgaaaaaccgtgcatttggggcagtggtattatggtcatttcgttgctattttctgttttaataaaatcctagaactagtagcaaccgagtaaagattgagtttgcaa

SEQ ID NO: 11275 - DNA, 3328 bp, Homo sapiens
tgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccagaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtataattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcattttggtttcagacttcaaagttgattaataaatttaatcttaactttttattcactggaatcaaaatgatggttggtactgtgtttactgtttaaaatgaagtactaaagccctgagaactgcacctcattttctttatccagaaattgtgcttatatattttcctgtcaggtttaaaaagatgttttaattcataaattattgttttcattgacattaaaagactgtgatattgaaagatgaattacgaaatttgctgagattgtttagtaaaattttgctggtcaaaaaggtgtatttctacaatttaccttttcatttttataaattgcagtcatttttttaaattttatgtaaaatgtaaaatgaaatagctatcatgaagcagaatacaatgatgaatgtataggttgagtgaataaccaatttgcagtggtggattgagaagtccagtttgatttcattgggacagactgcaaagtgtagttgtttgagcaaacacaaagaaactttgtgtttttgaagacaatcagaatgattacctttctacctctaactaatcaggtattgattgacaactttttggcattataaataaagtaaaatagatctctgcattcca

SEQ ID NO: 11276 - DNA, 3102 bp, Homo sapiens
tgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccagaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcattttggtttcagacttcaaagttgattaataaatttaatcttaactttttattcactg

SEQ ID NO: 11277 - DNA, 346 bp, Homo sapiens
gcagtggaaaaatgtagtcactctcccatttgtaatgaactgtaagtatattctcacaaatggatgcattttggagtaaaatatggtaactgacagttccttcttaattttcattgtagtatcattggaatctgaccaacatcctggaatttttattgctaacttttaaggaaaaaaaatgaaggccgggcacggtggcttatgcctgtaataccagcactttgggaggccaaggcgggcggatcacgaggtcaaaagatcaagaccatcctggccaacatggtgaaaccccgtctctactaaatacaaaaattagctgggcatggtggtgcgtgcctgtagtccc

SEQ ID NO: 11278 - DNA, 634 bp, Homo sapiens
ttttcttttaaagtagttagaaacttaagatcaaattctgtggttttggctgggaggaactgcagttgatgatcaaactgtttaacctttccctaggacacagctagaatatgtttccaagcctccccaacacgtgtgactgtgtataattgagttctaaccacaggaaggtgagcagaagtgaggtgtaaccatttccagatctggctcataagggtctcccacgttctcactgtcctctatgctctttctctgtgcacagcttgatgcagatgagcaggtaaccatggaagtcgtgagctgaggctgcagagtctagagccagagtgtggaataaacttgggtctcaaatcacccctggagcaaagcacccatctaatcaggaacttctactttcaactttacatgcgtgagaaatgaacttctatcatgttagagtgagtatacagtttttgtgtctgtgttttagtagctagtgtcaccataacaaatataattcacaacaggatattcacttttcaaaatcaagttgggtacagtttgaccaattggctacatgattaggaaaatatcttgatcaaatagttttcttctaaacacttacatcactattctgtactcacactgtaaagtt

SEQ ID NO: 11279 - DNA, 624 bp, Homo sapiens
tgctggtgtagggaaaggaatgggaatgttgaggggatgggaagaggcatcaagaacaggaatataattttcctacagtgctgttctgctgagactacagagtacctcagggagtcatgcatcctcttcctgttgctttactgaatcttaaagagcaatacagtactaatgatgccattctagcaactggagcagcttcaggggagagagcacattaagggtgctgggatggtaatggttgggaggaagctgaatggtagtaagagagacattctgtcctgagaactctgatccggcttgatgcagatgagcaggtaaccatggaagtcgtgagctgaggctgcagagtctagagccagagtgtggaataaacttgggtctcaaatcacccctggagcaaagcacccatctaatcaggaacttctactttcaactttacatgcgtgagaaatgaacttctatcatgttagagaaatccttacacggcgcccttgagagctttcatactgcaagtcatccattttcctcccctcaaacctggcatcggagtttattgaaacaaagcaaaataaaacaagatgcgtccgtttcttttttttcttctttcccctttcctcgccaaac

SEQ ID NO: 11280 - DNA, 576 bp, Homo sapiens
  misc_feature (74)..(74): n is a, c, g, or t
aatttcctccatctgctggtctgtctcagctggaaatctccatcatcagtcagtggactgatggatcatggcantaaaactcctcagtagaaggcagctgcattatctaagcgggggaacatgttaaacaggtaccattataaaaggaatgacttcaggtaaaatagaacaatgaagaggctgtcgttttgaagtcaaatctgaatttctcacctggctctattactttcttactgtgtaatgctgggcttgatgcagatgagcaggtaaccatggaagtcgtgagctgaggctgcagagtctagagccagagtgtggaataaacttgggtctcaaatcacccctggagcaaagcacccatctaatcaggaacttctactttcaactttacatgcgtgagaaatgaacttctatcatgttagagaaatccttacacggcgcccttgagagctttcatactgcaagtcatccattttcctcccctcaaacctggcatcggagtttattgaaacaaagcaaaataaaacaagatgcgtccgtttcttttttttcttctttcccctttcctcgccaaac

SEQ ID NO: 11281 - DNA, 458 bp, Homo sapiens
  misc_feature (74)..(74): n is a, c, g, or t
aatttcctccatctgctggtctgtctcagctggaaatctccatcatcagtcagtggactgatggatcatggcantaaaactcctcagtagaaggcagctgcattatctaagcgggggaacatgttaaacgcttgatgcagatgagcaggtaaccatggaagtcgtgagctgaggctgcagagtctagagccagagtgtggaataaacttgggtctcaaatcacccctggagcaaagcacccatctaatcaggaacttctactttcaactttacatgcgtgagaaatgaacttctatcatgttagagaaatccttacacggcgcccttgagagctttcatactgcaagtcatccattttcctcccctcaaacctggcatcggagtttattgaaacaaagcaaaataaaacaagatgcgtccgtttcttttttttcttctttcccctttcctcgccaaac

SEQ ID NO: 11282 - DNA, 395 bp, Homo sapiens
gatatgtgtaagtgttgagcatttgaaatatgtgtgaccaaggaactgaattttgaattttattgcatttccatgactttagatttaaatagccaggctagtggctaccaaattgtacatagagccctcgcacctcttatttgctcctttgttaatttctgtctgccacataaggatgaaacttgcctatgcattagtttcctcattttacagtaagggaaacacccctggtacaaagtaaatactcaatgctcattaatcaccatcatcatcaccattattataacattatcattattagtctccatgagatcgatgactttatgtttgttcactcctgaatcccattacattctttagcacatagcaggtgttcaataaatatattatgaatg

SEQ ID NO: 11283 - DNA, 415 bp, Homo sapiens
ttgcccagtggctattccagggccttgcttggacagttgaatacttctccatcacaatgtgttactgtgattcctagccaccccaatcagcctgcccggcctgagacactctctccactcggtcagtcaaacctagactccagagtctattcatagtaaatactacagctaaggcaaaatgcacagcaatcctagttcaaggaaacccccctaggaaagaatcagcagtgtggacaaagattaatattcaaagatattcactacagcaaaatatatacaccaaaaggctgggaacacctcaatgtccaacaatatgggaatggttacattatggcatggctctatgataaacttacgcaattattaaaaaaaaaaattttttttttttgagatgaagtctcgctctgttgcccag

SEQ ID NO: 11284 - DNA, 248 bp, Homo sapiens
tattattcttgggctaaattgataagctatttagatcactgcagaaacttgtctctgtctattcaatatcaaatgcacaaaattacagttttgggcttaagaggctaacacaaatgacatagtaggtgcctgtgctctgtttggagaattctagatttcaaattaactctgtataacaagggagaaacaaaaaagaaaaagaagcataatgaagagaaaccaatgtaattttaaatattctaggagaa

SEQ ID NO: 11285 - DNA, 355 bp, Homo sapiens
  misc_feature (6)..(7): n is a, c, g, or t
  misc_feature (9)..(9): n is a, c, g, or t
  misc_feature (12)..(12): n is a, c, g, or t
tcagcnntntanttttaaatttaggtaatctcacttttttcatcagagtttgtttgatatgattctactttccacatgtttcttattcgctgttttgtcttttaaggcagggaaagtgagtcaaaagcaaatcatgtttcatgtgaatattggactttggccacttctttccccctacacaaagaaaataaaggtgcaagttacctataattattaacagtaatagtttgagagaactgatatgttaaagaagtaatcattaatcttgctaatcgttggtatgttgagaagtatttggcctttggtgttggtgttttcttgtatgtgtctatgtgtgtgtgtgtgtgtgtgtgtg

SEQ ID NO: 11286 - DNA, 942 bp, Homo sapiens
gtgccatgcagcttttaaatgacaggcacgtgctcacaggcttctgttcagagagaacctgtgagctgtcctgtggcctttcctgtttacggtgcagccatcccaaatatgatgcccccaaatccgagtctggctagaaggaagtgtcatacaaaggccatgccattctccctgacaaaagacatgagtttcttgcaagagcactaagaagttttaagaggtggactcgaagagaggagaatgaattggaaagccagcacgaatgtggctcttactcctctgtgaaatatttgcaggaacgagcctggagaccagcaggttcaggatggaaagctggaaagaattctttcctaaaacttaagttttagagaaaaataggcagccagtcccaaccacccaaaggcgtccaaagccatgtttgttctgggaaggccaaggcatgggaggatgttaacttgggctatcagcaggattgaagggcagggtgaccttggtacgctctcagggcctgtgtttccaagtcgacaaactgttctgagcttttccatgaaacgagtgaagcccttttcatacctccttcgtgttccagaattcttgccatcgatgttccaaaggatctgtgatagatttatgtctagccttaaatgggacgagttgtaacattcagaattattttatctttctgagacctgctattattgtgagaccctagacatgctttgctggggttagggtgagggtactcctaacgagggaaggaatcttccatttgtgcctgcccaaagcgttctagaactgaccggacctgagaggctgtctcattagaactaagagaaggtattgttgatgatgtcttatatccatggaagaattccctgggcattccctctgatgctgcctgggatacctacattgctcaaagtacagtttctttatgaatag

SEQ ID NO: 11287 - DNA, 549 bp, Homo sapiens
gctctgtgtctagagctgccagttgcccgggaaaggagcagctacgttgccaatcttcacgtgcagttggctccatctgtccttgtgacatttgatttggggccaatgtttaaaacactctttgttttctcccccaagtgatctctccctaatcaagagccacatggcctctctctgtggccatttcagccactcaggaggaagaatgaatgcctaaatctttgaggtacacccccaaccccaagttccttctagaatctacagtaggccgggcacagtggctcacgcctgtaatcccaacactttgggaggtcaaggcgggtggatcacttgggttcaggagttcgagaccagcctgggcaacatggcgaaatcccatttctacaaaaaatacaaaaaattagccagatatggtggtgcacacctgtagtctcggctactcaggaggctgaggcatgagaattgcttgaacctgggaggcggaggttgcagtgagccgagatcatgccactgcactccagcctgggcgacagagtgagaccctgtctc

SEQ ID NO: 11288 - DNA, 353 bp, Homo sapiens
  misc_feature (253)..(253): n is a, c, g, or t
  misc_feature (316)..(316): n is a, c, g, or t
ttccacagtatgaaaaccatgtggcccatggttcacagtatgaattacagcctccttttgtcaaatacctttactttcactgtatcctttactctgggcaaaaacatgtgaaacgttcaagacagctctaaagatttttcataattagaaattagtggctgggtgcagtggctcatgcctgtaatcccagcactttgggaggtcaaggcaggcacactgctggagcccaggggtttgagaccagcctgggccngacatggcgaggataccgcagtgacaaaaaccacaacaattagccagggtgcagtgccacgcncctgttaggtcccagcttacttggggagggcttgagg

SEQ ID NO: 11289 - DNA, 269 bp, Homo sapiens
gggtcctgccaccaaccctggataatttttgtagttttagtagagagtttagtttcactgttagatatgagttctaaatttctcttcaaagaatcaatatgtcagtatgttcaattatttgccttctacttggcgataaacttaacttcctcgtaaagcaatctttcaattaccttctctgccctgactcattccaattacctactctaccccaactcattccaattatctgctccaccctgactcattccaattacctgctcattctc

SEQ ID NO: 11290 - DNA, 1176 bp, Homo sapiens
tggtaggcagtgggcatcgccaggtaaagtagagtggctgcccacggcccggggtggacacagggcagagagttgggcagggtgggggatgttctccaaaacacttgagtgtggcttaaaaagttcatgcaaccctgatagtttgaggcaaaggctggtttctttgccaaacgttagatttaataaaagaggaggtgtttggattgtttaacgttcagacttccttatttcccttacttcactattttcaaaattgtgacgtttaccttgccagttcatgcaggactttacagaagaactcgaaattcaaattctgagctgccaccaagtttttacaattaaaccattttaaaactattgttctgaggtagtggttaatttcccttctttttctttctttcttctccttttttttcttttttttatgatttaaaacttactagttagaaacttttttttttgcctcaccagcttcaggaaattttcttttgaattgttagaaaaacaaacaaacaaacacacagacgcacgcacacgcacgtatattcttccaccctgtagtataaagaaaacatttttaaatccgaaaatgaaatatgttacctttttccttccaaaagtagactgtgagtgatgtttgtgtggtgtcctttgcccccatttcttactgtagttttatggtataaaatcctcagtatttgcttaattttttttgtcattgaggaaaactaacagtaaaatgagttaacctgaaaatgcccttttcagttcagcattcagagtgaggaaagaggtatatatgcagttaaggtgagaacggaaccgtagcttccgccggcggacttgtgagcacgtcagaaagcgaatgtgcctcactagaacgcacggtggcggcaggagtggccggcagtgcccggcacgcagtcacgggaggtgggtcgagtcctggtttatgtgagtcctgtgaggtgagagagtgggagaaaacgcctcactcaacttaatgcctttgtttgtttgttttaaccaagagtttacttgtaatttagtattgccggaaaattgttcaggtaaaaagtgcctagtataaataggtacacagtcaggtcagatatgttaattgcatctcacttgatttaatgaaaatttaccatttgttttgaggtcagtaccatt

SEQ ID NO: 11291 - DNA, 228 bp, Homo sapiens
aaaaagaaaattagctaaagcaactaaaatatccaagaacaattagaaaactacataaaatagtttatatatttaagttttaaattgaatggctaagcagtttttaagttataaatccaaagccactattcgagagaggaggaaaagggtgcagtgtttgaaatacggcaggcaacatggacccaaaacaaattaccagcaccataaaggagctcctggatctccatc

SEQ ID NO: 11292 - DNA, 233 bp, Homo sapiens
cactatagtctcgaacttctgggctcaagcaatcctcctgtctcagcttcctgaatagctgggactccagccatgaagtacaatcaagaagaaattgaaaaacagtcagagttagatgatgagcttcatcgtttgtcatgcaggatttttatcccctgaagaacctgctagagaagtccaccttcacccttaaccactggtgcctcaacttaatacttttaaaattcatttgt

SEQ ID NO: 11293 - DNA, 395 bp, Homo sapiens
cacacaaatttaaatctatttctacatctatctttatatattttttaatctaacttttattttagatacagggcatacatgtacaggttttgtacatgggcatattgcatccaggtggtaagcctagtacccggtaggtagtttttcaacccacactccccttcctccctccactctctagtagtctgcagtgtctgttattctcatgtttttgtccatgtgtgctcagtgtatagctcccacttataaatgagaatatgcagtgtctggctttcttttcctgcattaattcactcaggattgtggtctccagctcttctatgtctctgtgaaggacatgatttcatcctcctatatggttgcatagtattctgtggtgtatatatataacacac

SEQ ID NO: 11294 - DNA, 100 bp, Homo sapiens
tttccttgtggtatctgcacccagccagccaccacctttcctcccacaaccgtgaacctctcagcctgtgtggacaggcgtagctttggctatacatgac

SEQ ID NO: 11295 - DNA, 320 bp, Homo sapiens
cttaagtattcttttcaagctttgtgttacttcttgaagaacttgaaacaattttaagaaagacaagtgaacagttaaatgaattgtaatacaactacctagtgataactgctgttaatatcctgtgcacatatataaatatatggtgaatttgtgtttttagttatatccagaattgtttgttaatatacatggacatacctacatattattctataagcaatttatgcaactgtcttactgttgttggacattcagaagttttttctaatttttcactcttagaaataaagttttagtgagagtcgcaatgcttaaat

SEQ ID NO: 11296 - DNA, 444 bp, Homo sapiens
cctgtttttgttcactgccatttctagcacttgtttagccctgtggtcagtagatatttgtagctaataatatagaatagtgtaaagttagactagataacctaaggactttccagccccgcaactctgttaatgttttgattctggaaaaataagctggggaacaagacaaaaataaactctgaacaggattcataataagcagaatgcaaaagtcataggacttttgactgcaaaagtcataggagcagacatatgcagttttgacatatgactgcaaaagtcataggagcagaaagctttgattattatcaaaaacaatgaaggtgtcaaaggcctggaacaaagtttgctgtgggtaggtaagaaagagaagcttgataatcgttttatccattgtaccttagccggattgacttgcagaaggtaagccatggtgaaaaa

SEQ ID NO: 11297 - DNA, 402 bp, Homo sapiens
ccattaaccacagaataaggttgaaattccttaaaatggaatttgagtttcttcataagctcctgtctgccacccagcctcatcagacactcctctgtcatcttatgctccagtcttaccaacttttgcatgtcttattccctctgcgtgtataattctttctcctcttgatttatacagcaaatcttcctcatccttcaaggcctagtgcaagtctacttggtactgtccctaagttcgaagacatctaagtgtacactcttcaccagagaactgcccgagctctgcccagcctcttacactgttaatgaatgcatcctttttgaaatgctctcctttgtctgacacaacacgagccaggctttcctcccacctctacagccgcttctcttcagtctactc

SEQ ID NO: 11298 - DNA, 2909 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11299 - DNA, 1945 bp, Homo sapiens
ttcccactgcgaagctgagaaccctagctccggccccgaccggaagccccaccgcaccgtcagggacgcggactcgggagtgcgcacattcgcagcccgggcagccctgctgcgcaccgggcctcgcgccccgcgccccgcgcgcccgcgccccgcgcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11300 - DNA, 3092 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11301 - DNA, 2128 bp, Homo sapiens
ttcccactgcgaagctgagaaccctagctccggccccgaccggaagccccaccgcaccgtcagggacgcggactcgggagtgcgcacattcgcagcccgggcagccctgctgcgcaccgggcctcgcgccccgcgccccgcgcgcccgcgccccgcgcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11302 - DNA, 2940 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11303 - DNA, 3097 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaaggggccctcttcttctccaagcagtgggagagacaggactacgaaaaaatggctgtaatggagtgtgatgggtgctgtgtggaactgtgccttggaaactgtgggcccagaagagggagcgtgacagatatcccagggacagccatggtcagaggtggtggctgagctggcctccaaccaggaggagcagtttgccagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11304 - DNA, 3114 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagtgggagagacaggactacgaaaaaatggctgtaatggagtgtgatgggtgctgtgtggaactgtgccttggaaactgtgggcccagaagagggagcgtgacagatatcccagggacagccatggtcagaggtggtggctgagctggcctccaaccaggaggagcagtttgccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11305 - DNA, 2900 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11306 - DNA, 1893 bp, Homo sapiens
ttcccactgcgaagctgagaaccctagctccggccccgaccggaagccccaccgcaccgtcagggacgcggactcgggagtgcgcacattcgcagcccgggcagccctgctgcgcaccgggcctcgcgccccgcgccccgcgcgcccgcgccccgcatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11307 - DNA, 3455 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtgaaaaaaaaaaaaaaaaaaaaaaaaaaaaaaaaaaaaaaaaaaaaaaaaaaaaaaaaaaaaaaaaaaaaaaaaaaaaaagaaacgaacaaaaacaaaaaaaaaaaggggggggggccccacaaaaaaattatcccacggggaggagcaccaaagaaaggacgcgccacccacatggtttttatagcaacaaaagcgagcccccaataaagagggggcaaatattacacaaacacagacgcgggagcgcacatatataaacaaacacagttgtcacacaagcacacaacagcatcacatagaagttgctggagcaaccaaccacccacttagctgagcgacaaaaaaatgtggcaaccaacccact

SEQ ID NO: 11308 - DNA, 2726 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11309 - DNA, 2591 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagtcagtcactacccacacaccacagagaaaggaaagggtacagccacatagcagacttggggtttggaagtctggtcaagggaagaggacacctgtttcttgagtacctgctatgagcccaccacttttacggccactttacatggaataatttattgaatgaggagaggtaatagagaacatggtttagagtcaaatgagctcaatcccaagtgagctctgagacattgggctagtttcctaaactctgtgccttggttccttcgtttataaaatggggataataagaatgcctacctcatagagttgttgtgagatttaaatcaaataatatatgtgaagcactttgcatacttcctggtaatatatggcttgatacatta

SEQ ID NO: 11310 - DNA, 2502 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtgaacattagaaagtacagcaataaaaag

SEQ ID NO: 11311 - DNA, 2515 bp, Homo sapiens
tgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagagaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaaggaatctaattgggaaggattgtttttattttaatgcaacctggtgatggtacttattctgtgtttaaaaaaaaaaaaaggatttctgaagctgcctttaattttctctaccacattcccactgagtggccatccagactgtgcatacctccagtgaccagactctcagtacctcataccagctctcaccattacaaaagtctttacattgagctagaatcttctccttctagcttacacagtctgattctacatccgagtgtttccagtatttagagaatcctcatttaccaagttagtcttccca

SEQ ID NO: 11312 - DNA, 1277 bp, Homo sapiens
ttcccactgcgaagctgagaaccctagctccggccccgaccggaagccccaccgcaccgtcagggacgcggactcgggagtgcgcacattcgcagcccgggcagccctgctgcgcaccgggcctcgcgccccgcgccccgcgcgcccgcgccccgcatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 11313 - DNA, 544 bp, Homo sapiens
gtgttttttttttccacagtacattttaactgtgttcagtgcttataaaaaatgtcagactgatggtgttgagaatgaaagttgtaccaactgatgagttaagtttcttgatgttcattttatgaacttcattaactgaaaaatataacagaaaataatgctttacagttcattttatcatatcttaaaagttacattgattctagaaaaatagaacgtttagtgtctagctagatactaaggacatagttggtgttcgataattgcttattgattgattaaactagtaaagggatattaaccctaaatgttggatttagatgaggaaactactacttaaaggggaaaaaagatttcccttggctttgttattctcatagcctctttccactgcacaattgatgataaggtgttgcccagacagacctgatttaagaattggtatttaactttatcccattgattataaagtgagtcagcaagatttaagtgttgaatagattcaagatacagtcacctttgagtcaggtggaaacgtaaaaaa

SEQ ID NO: 11314 - DNA, 450 bp, Homo sapiens
aaaatgtcagtagtgttgctgttgaaaaatcctaacctaattcaatcttacacctctatttcaaacctgcctataattttacttctatatgtatgtgttaatcatctgtagtagaatacaagcctttgaaatactaggaccacatctcatgcataattttatttcttcaaaaggcctagcacaaaggctggtatatgcatgggcactcaaaaatattaaaaaacctatgtgacatagaatatctaggtcactatttgttgaataaacatacaagaagacactaaccaataaagctacattaagttcaacatatacttttttctttttttatttattattattatactttaagttgtagggtacatgtgcacaatgtgcaggtttgttacatacgtatacatgtgccatgctggtgtgctgtacccactaactcgtcatctagcattaagt

SEQ ID NO: 11315 - DNA, 465 bp, Homo sapiens
gaaatcctgacctcaggtgatccacctgcctcggcctcccaaagtgctgggattacaggtgaagttttagtacagcgtggtgaccttggaaagcctgttctgcttctgacaaaagtggcctgagcctgtgggtacacagtgttattgggactagctgtgcataaaagatcctcctccagatccagcttcaacaggaccttgaagcagctgggaaatcaaagcttcaaatcgtaaagtaacatgtggaggcgacacaaatattatttgctgggagtgagagaggtactcacatgctcttttcacttattgtccagaagaagaacatcatgatggaagatacctttcactggagtcagtgactcttagctactgaataccttacccaataggtcaatgctgaatgttatcaatgaagtccataacaaaccatagctgtggataataataatccttcttataagacat

SEQ ID NO: 11316 - DNA, 934 bp, Homo sapiens
aacactatgctgttgccctggctggtctcgaactcccaggctcaggtggtcctcccaccttgacctcccaaagtgctgggattacgggtgtgagccactgtgtctggccctgtacctgacattttccatgataaaaagttaaaataaaaatgagacaggctataaaaatgacatttcacaggtcactagtgaaaatggcatgtgggtattaagggcttcgcacggagcctgtgggaagggctcctttccttgcaaggagtaaggtgtggtttctcccttttacaggtcaggaaaccactgttccccacagacttaggtacttgcccaaggtcatgtagtagttagtgagggagccaggctttatttatttatttacttgagagacggtgtcttgctctgtcactcaggctggagtgcagtggcacaatcacagtccactgcagccttgtactcctggactcaagggatctttccaccccagccttctgagcagctgggactgcaggtgcacaccaccacacctggctaattttttaaattttttgtagggatggagtatccctatgttgcccaggctggtctcgaactcctggcctcaagtgatcctcctttgtcagccataagagccaccttacccggtctgagagccaggctttaaatgtagttccagctgctttgaagcccagctctcacattccagctgtacttcctcttaagggacattgccagagctaaggtcagtctttgattcatgggcagacatcccctccacagatgctgctggggtgtgtagcagtaccatgggggacagctaagcgttggctcctggcagcaggaggaatgaggtcacttgggagagggggtgacatcagggtggactcaccccacaccactgctcgggagacctgtatttccagcagtaactcccagggcc

SEQ ID NO: 11317 - DNA, 2644 bp, Homo sapiens
cccccgtttcctgtagcccgcgccgtgccgcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgttttatagatgaggtaaaaagtcttgtgtgctgtgagttataatgcttttgcctttttaatattattagttcttaagtgttacagccccttcagaatataacttcaggacaattcaaactatgcttaatgtatgattttcgagcttctgtatgctaagaaaataggtgtgaaaaactggtgttctgaaatagcctaacatttattgtaattctgaattttctgcccttttattcattgcatattaaagtattagagtataaaactaa

SEQ ID NO: 11318 - DNA, 2381 bp, Homo sapiens
cccccgtttcctgtagcccgcgccgtgccgcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgtttt

SEQ ID NO: 11319 - DNA, 2724 bp, Homo sapiens
cccccgtttcctgtagcccgcgccgtgccgcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgttttatagatgaggtaaaaagtcttgtgtgctgtgagttataatgcttttgcctttttaatattattagttcttaagtgttacagccccttcagaatataacttcaggacaattcaaactatgcttaatgtatgattttcgagcttctgtatgctaagaaaataggtgtgaaaaactggtgttctgaaatagcctaacatttattgtaattctgaattttctgcccttttattcattgcatattaaagtattagagtataaaactaaaaaaaaaaaaaacacaacaagtttgggggggcggcccacagattttaagcaaactggttgggggggccaaggaggatggc

SEQ ID NO: 11320 - DNA, 2395 bp, Homo sapiens
cccccgtttcctgtagcccgcgccgtgccgcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgttttatagatgaggtaaaaagtcttgtgtgctgtgagttataatgcttttgcctttttaatattattagttcttaagtgttacagccccttcagaatataacttcaggacaattcaaactatgcttaatgtatgattttcgagcttctgtatgctaagaaaataggtgtgaaaaactggtgttctgaaatagcctaacatttattgtaattctgaattttctgcccttttattcattgcatattaaagtattagagtataaaactaa

SEQ ID NO: 11321 - DNA, 1618 bp, Homo sapiens
cccccgtttcctgtagcccgcgccgtgccgcgctacgcccgccgggagccgggcagagcggccaagatgtcgcagcccaagaaaagaaagcttgagtcggggggcggcggcgaaggaggggagggaactgaagaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgttttatagatgaggtaaaaagtcttgtgtgctgtgagttataatgcttttgcctttttaatattattagttcttaagtgttacagccccttcagaatataacttcaggacaattcaaactatgcttaatgtatgattttcgagcttctgtatgctaagaaaataggtgtgaaaaactggtgttctgaaatagcctaacatttattgtaattctgaattttctgcccttttattcattgcatattaaagtattagagtataaaactaa

SEQ ID NO: 11322 - DNA, 2405 bp, Homo sapiens
cccccgtttcctgtagcccgcgccgtgccgcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagtttgtcgttgggtgtttctcttcactcagcaatgtgacgtgtgattggaaacctgtttgagggactcgtcacatattcctgttgctcttcctgtggcaaaatggcttcggtttaagaaactggggggaaaggggaaataagtagccaaatggaaattgttcgtaaaagaagggcaattgcctaaaaagagg

SEQ ID NO: 11323 - DNA, 329 bp, Homo sapiens
ttcagagaattatgttcactctcttgattgtggtgatggctttataggtatacatatgtcaaaatttactaaattgcagacttcaagtatgtccagcttattatatgtatcaattataactcaaaaaatacttgctcaaaaatgacaatatctaattatggctggatcacaagagataaacaagcagatggaaatccatggagtggtaatgagaaagaaagacctctcaagcgccaacatggctagaccacatgcagggatggatctggtgtgtactgcggtcttgaacttccctttctttagtgtcagcccacttcttccttctcccg

SEQ ID NO: 11324 - DNA, 511 bp, Homo sapiens
attcctagcatcttgccttgggtataaatgtgtattgaattgaatggatatggatgaatttttttttttttaagacagggtcttgctgtgtctctcaggctggagtgcagtggcacaatctcgactcactgcaacctctgcctcccaggttcaagtaattctcctgcctcagcctcccacgtagctgggactacaggcatgcgccaccacgcctggctaatttttgtatttttagtggagaacagggtttcaccatgttggccaggctggtctcgaactcctgagctcgagtgatcctcctgcctcagtctctcaaagttctggtattacaggcatgagctaccacctgggccttatgtgaataagtcttatgattaaaatttattcatattgggccgggcgtggtggctcacacctgtaaacccagcactttgggaggccgaggtaggtggatcacttgagatcaggagtttgagaccagtctggacaacagagtagacctcatttctgt

SEQ ID NO: 11325 - DNA, 937 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtgagtcggcgggcggcgcggtgtggggtcccgtccacacccctacgagccttcacctgcagagtctcagggctgaagccgctgagggtgctgtaagaccggcgccgtgattaacccctgggcacttcggtctgggttccaaaagtattccatgcgaaagattcacgtgcctctttgagtaagcctttggtattgttaagtaggcagctttccgggtaggatgtgctgcccttaaggatccaatcatatggcgtgtattttgcccatatactgtaatgccaaaagttgtgtttggttttgatgtctccataaatccaggttttctgcttaaaattccaaagattttatttagttatacggggttttttttttctttcatccctttaaggggaacttcataaaatgacatttagtaaaactgttactcctcctttatgctttttaaaaacagtattcgtacttcgtgttaaatttttgaaacatttaaagtattttttggacatactcccaactccatccacaagtcccgtgagaattggactctcctttgtgcctagatagggttctgggttttcctctattgtagctccagtcacagtattttaattgcctgtctatttcttgttttgctaccaaactacacgcgttctgaggacaggttctgtgtattctgaggaagtagagaataagagcaagtacttgaggacagtcctgc

SEQ ID NO: 11326 - DNA, 821 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaggactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaactggaagatataatccagctaagcagaagacagtgagtgccaagagaggaccagtaaaaaagattacaagaccaaaccatcttccagaactccatccatgattccagaactggatggatttctatttcttcctttttttttccatttataatattcaagttataaagttaatggtcagcacatttcttcagggaataaaatagataagaactgccaaa

SEQ ID NO: 11327 - DNA, 2175 bp, Homo sapiens
acgcagcggctgtggagctcctcctgctgggaggctgccccaggacccagcacgtgcgcagcggccatggcttcctcaattatctgccaggagcactgccagatctcgggccaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaacctaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctggctaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgagcattgtaatccat

SEQ ID NO: 11328 - DNA, 1658 bp, Homo sapiens
  misc_feature (940)..(940): n is a, c, g, or t
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaaggatgcagtgcaactctcaatatttgaactaagacacaagattacggaactggaagccaaactcaatactgacaatgaaggtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtgaaagtatgaggtttgcagtccaggggtggtgcagtggctgtataatgccttcaggaatccaggcttcccctaagtttctactctgccatccatttgtgagtggcttttgtcctcgtgtttaaagatggctgcttcgccttctcagctgcttcacgttatcattcaaaaaaagacataggtgaaggagaaatggtaaaggtgaaagccggtcacgtctactccccttcaaagagctttctaagatgctgcacccagtaattccccttgacatttcattgggagttagaactgtatcatatgggcaccttcgtgtgcatgacaggctaggaaatatagtgttttactgaatatacaggaagaagagaagagtggattgtgagcgtacagttggctgtatctgccacacacaaagtcatttaaagtgaaggcatttcattttatgtattcattcaattcattcatacatattcgttcaacatgtattcngctgatattatttggaaaataaaaggtatagaaaaagaatatcataaaatcaaacatatccactgtagacagttctgtttttagtaatttttgtatgcatacatattgattaaaaagaacaaccaaataaataagtcagccaacaaacaaagtgaaaaaggattacagctagtttttattgttgtttaaaatataattataaccttaccgcatggacagttttgaatcctatgctaattggggtaattaagtcaattatttcatatgttatgttctcttcatgtgcatttttcaatgatatattatgttccattgtgttggaatgtgaatgttcaattacttttccctataactgggtattttaggttgtttctggttttaattttgagttgaaacccacagagtgtattatggcaaacaactccatattctagtatttataaatcttcagatctttgtccctttttgactttaaatgttttaatgaaaacaatttatagagttgagatcccttttattctcctccctgtcttctttttgtttccttttcataggcaaggactaccatgaatttggtatatattatttcagtttatttttaatatctctctacatgttgtatgtataaaaatgcatataaaaagtatcatactgtgcatatcattcttttactcattatttaattccattcatgttaataaagatctagtaaatttta

SEQ ID NO: 11329 - DNA, 1021 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagactgtacttctattacgtgtctatgcaaccgaactgccacgtgacacgtactgaggattacgcacgtccaacgggttggtgcagtggcctgtatacatgccttcagaggaatccaggcttcaccgctaagattaactactactgaccagtccaattatggtgagatggcatatagatcctcagtgtataaagaatggcatgactttcgacactatcctcaggcatgacttacacgattatcaattgcacaaacaaagacataggtgaacgggcagcacacattgcgacaaaaggtgtgcacaacgcaccggattcagcggatctaactcgcgccgaatacacaaatgaaaccttatccttcaaggtagttggcctgtgataaccccaacagaagaagtatccccgcacgtttgtgaacgagttaatcaatttggggggaagggttgaaagaaaaacgggtgttaagttccaattaaatatgtgggcgaacacacattaccgaaatagattgaccaattggaacaaggggctcgtatcgtgaaaaacgtggtaagaggcagcgttatataagagtgggaggattaattagacagggcacagaaaatgaaaggagaacgcaggtggccaattaaggagcgcaaggaggtaacatacgaagagtgaagcagagataatatcactgcgcaaa

SEQ ID NO: 11330 - DNA, 922 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagacgtatttcaaagagaagtttgaagactagcgcaaggtccaaataaactgttttgttcaagggatctgtttgaaggacaacaaataatttttgagtagctataggtggagcactaagttgccagctatattcacaggtgtcctgaagagcagagcatgtatagatattgctttttgaatcaccgccaaccttcagagaaagatatagacaaatactgtgtttttgctaataatgaattgaggagaaataagtccttttgcacgcttgttactttcaacccagacatgcctttatttccatatcttggaaagtcaggaatttttctaactcgaaaaattgttttcccatgtgctgtcatagagttatatcgccctcttgtggcatttagaaatagttgctagggctatgttaagcttagtgccttttcttaattgcaggtagaattttattactacctactggatataaaatattctgtctacctgcttcttgataactgaggctcagtcctagctcaacagagtgggtatcaccacccttgtggagagtagcaacaagtgctggtatgacttagtaaaataccttaggg

SEQ ID NO: 11331 - DNA, 439 bp, Homo sapiens
gtaaaaatacaataaactggttggaatatctgctttattagcatatttgtaccttcgctgtccttattcatgttctattcacatctcttcaaacagcctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgtacagaaaagattgggacccactctgctggtttagtgtggcttcatctctcaaactgaatgaaacttcttccaactctcctc

SEQ ID NO: 11332 - DNA, 2665 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaggactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaacgcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaacctaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctggctaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgagcattgtaatccat

SEQ ID NO: 11333 - DNA, 2624 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcaggaatccttaaacacattacttaaacagctagaagaagaaaagaggactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaacgcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaacctaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctggctaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgagcattgtaatccat

SEQ ID NO: 11334 - DNA, 2891 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggctgcagttttctagtatattaccattgatttatataatcagataaaagcagctccttgggaagatcaagaacattaagttatgaacagtccagtgaattggaagtgatggaatgagagagtctgttcttctgttttaaagatatctagttcattttggagtcagtaaaataagagggaaccttaaagttattgtagtacaattttatacttttcaaggatctctggaatccttaaacacattacttaaacagctagaagaagaaaagaggactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaacgcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaacctaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctggctaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgagcattgtaatccat

SEQ ID NO: 11335 - DNA, 2840 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaaggatgcagtgcaactctcaatatttgaactaagacacaagattacggaactggaagccaaactcaatactgacaatgaaggtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtgaaagtatgaggtttgcagtccaggggtggtgcagtggctgtataatgccttcaggaatccaggcttcccctaagtttctactctgccatccatttgaatccttaaacacattacttaaacagctagaagaagaaaagaggactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaacgcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaacctaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctggctaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgagcattgtaatccat

SEQ ID NO: 11336 - DNA, 947 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaggactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgtacagaaaagattgggacccactctgctggtttagtgtggcttcatctctcaaactgaatgaaacttcttccaactctcctc

SEQ ID NO: 11337 - DNA, 1104 bp, Homo sapiens
tgcgggcaggcgcgggaggtgcgacgggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaggactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaacggaatttatagctaaggaatacaaagcaaaatcaacaaaggcataaggcacatgggatgaattctcagaaaactaggctcaagcttccgaaagttttctccaagttagggtcacataagaaatacttaattcctccagcaaaaaattgcaacaacagcctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgtacagaaaagattgggacccactctgctggtttagtgtggcttcatctctcaaactgaatgaaacttcttccaactctcctc

SEQ ID NO: 11338 - DNA, 236 bp, Homo sapiens
caaggtccgcatcaacagtaataagttgtgttagtagcatgcactcttaatatcatatgaggagaagggcactttacctctgtggtcttcctcctaaaacccgtaagcccagtcaagaaacccataactccatgagaaaaacatcaaccaaaaccatgttgaaaagacagtctacaaaacacttgaccagcagtcctcaaaactgtcaagaacaccaaaaacaaggaagctctgga

SEQ ID NO: 11339 - DNA, 442 bp, Homo sapiens
ctttaaatagctgccatgaaatgttgtcattagtttgctatctgcagggaaaacaaaatgaaacaggaatatacaaaatgagataagagtctctcttaccttacataaaccttatgtttgagggcagggggcaaacctttaaaaaaaaattatttatttatttagagacatggttttgccatgttggccaagttggcctcctgggctcaagtgatcctcccgcctctgcctctcaaaatgctgggattacacgcatgagtcaccactcccagctgaaaatttttaaaatttattgttagttcatatttgggaaacaaaaagctcacttttcagtctgagattttgcaaaagtggaagtgtagtgtaaaaaaatataaaacatacataccaatagccagcctaaaactgcttgttagcaacccaagctagtaattaaaaattt

SEQ ID NO: 11340 - DNA, 686 bp, Homo sapiens
ccagagtgagggctccacccttccctcatgcgtttatctaaccctaattatctctcaaagtctcccaaaggcctcaactccaaatgccagcacagtgagagttaaggcttcaacatataaattcggagggacgcaattcaattcatagcattagtgtttttttgttttgtttttacttttttttttaagagacagggtctcattctgtcacccagactggagtgcaatggtgcaatcatagctcactgcaggttgaactcctgggctcaagcagtcctcctgcctcatcctcctgtgtagctggggactgcaggcatgtgccacacccggctaattttttctttctttctttttttttttttttgtagagatggagtctcactatgttgccccaggccagcctcaaactcctgacctcaaacaatcctcctgcctcagaccccaaagtgctgggattaacaggtgtaaaccaccatgcctggcctacattagtggttttgaaatgcacctgtttcacttcaatatggccatttattcattcactttagtaaacacttaatgagtttctattgtttccagtgattgtgttgtgccctgagagaaaaagcagagaggcctgaattagcacctgctgccaattattcacagtcaacaatggacaaagggcttactttaaaaccaaaaaa

SEQ ID NO: 11341 - DNA, 226 bp, Homo sapiens
gacacacagacacacagggaagaaagccatgtgaagatggaggcagagattgcagagatgcagctacaaccaaggaacaacaaggattcccaggagctaccagaagctaggaagaggcaaagagggattcttctctagagccctcagagggagcatagccctgctgacaccttcattttggatttctagcctccaaaactgtgagataatacatttctgttgttgt

SEQ ID NO: 11342 - DNA, 456 bp, Homo sapiens
caaagacagccagggcttaaatcaggcctttctgatgtagaccatgctcttcactaccacagagttccatgctactttctctccctctccctcctctcctgtccctgctacacacacacacacacacacacacacacacacatgcacactcactcacacacactaggaggaacaaatgagatcattcacatgaaagcacttatgtttctgaaatttaagggactgtggtttttatctaggttgacctctcaagctaaaaactgggaaccagaataatggactgaaacttgggtttcacttccagaccagtgttgatcctctgaattgatgaaactgtatagatttccctcttgattgcccctgctaacatggatttcctttcactcaattcctaatgcaaatattgctgaccactgtttagatgtttacatgctgcattacattgatattttacta

SEQ ID NO: 11343 - DNA, 837 bp, Homo sapiens
ttgatctcagggtctgttcgacggaagcagcaaaaaatacaggctcccaacgtggctccactgtctcatgaagtgtcaaaaatttaaaaatacacctcactttctattcagcatcagctattgaaatggaattctccttttctattcccgttgtacatagccccacgccctgcctccggctttgtcctctgtacagagccccctgtcccctctgctgttccggacccttttcttgcagcagctcaaccccccgactcactcagatccccaggactgcagccgagccccgggcttcctttcttaccattctgtatgcttccaaggtgtgaccattcaaactaacagtattattaagattattaataaagatttctttcttcaaaccagcgaaaaaaaaaaaaacaaaaaacaacaaaaaaaacaaaaaaaaaaacaaaaaaaaaaaacaaagaagagggggcggcgcgccacaccaaggagattccccccggggggcgccaccggaagccagacccccacttttgttgagtcaaaaaggggtccccaaaggaggggcggccctataataaacagggggcccgcggcgccggcgggtgtataaaaacagcaggctcttgactgagaggaaaccacgctgcgccacctctgtaagaacacactcttgtgaggagaaggaccaccatactactgctgtgcgggggcgcgccacctcttgctgtcctgtctttccccttagaaggattttaacgcgcccagggaaaacgactaccacgtcaagagtacataggggtgaacacaacggaaattctcctgcgcagtaaaagttgcgctaaaggt

SEQ ID NO: 11344 - DNA, 1520 bp, Homo sapiens
tgccagggggccggcggggctgaggggtgcgggcagctttcatcccaggggctccactgggccccgtcaccctcctgtcgcgtcccctgcgtcccacctccctcctgcccggcagtcccgcccgtgcccccagcctggcgaggaagccgtccaacagtagccccggggccagctcccaacagaaagggctgacgtggctccaggactcaggggcgctccatgggaggacgaaggaagcccagccagccaggagccactcctcacacctccaagtgtggccaagtgggccctgaggccaaggacttacttgctcttcctggccatctctccctttctggaggaggcccggggcctgtgtacaccaaggctgacctcgtgctgcctgctgggacccagccctccctgccgctcccctgtgagcccagtccaccgtgggcgcccagggccagggacgggccagcgcccggctgcatcgcgaggttgggagtcacagtggctgtgggcctggacgggcacagccagagcaggggcccatgggaagggcaagggatggggaagcctgggccggccccttccctgctcccaaggcaggtgtccaggtggcgggagcagcaccaaggacagccaggcttacccggtgggaggagcaggagcagagcaggtggcagggaggaacccctggcgaggcagggagcactgaagtagggaagcagcaaaaaatacaggctcccaacgtggctccactgtctcatgaagtgtcaaaaatttaaaaatacacctcactttctattcagcatcagctattgaaatggaattctccttttctattcccgttgtacatagccccacgccctgcctccggctttgtcctctgtacagagccccctgtcccctctgctgttccggacccttttcttgcagcagctcaaccccccgactcactcagatccccaggactgcagccgagccccgggcttcctttcttaccattctgtatgcttccaaggtgtgaccattcaaactaacagtattattaagattattaataaagatttctttcttcaaaccagcgaaaaaaaaaaaaacaaaaaacaacaaaaaaaacaaaaaaaaaaacaaaaaaaaaaaacaaagaagagggggcggcgcgccacaccaaggagattccccccggggggcgccaccggaagccagacccccacttttgttgagtcaaaaaggggtccccaaaggaggggcggccctataataaacagggggcccgcggcgccggcgggtgtataaaaacagcaggctcttgactgagaggaaaccacgctgcgccacctctgtaagaacacactcttgtgaggagaaggaccaccatactactgctgtgcgggggcgcgccacctcttgctgtcctgtctttccccttagaaggattttaacgcgcccagggaaaacgactaccacgtcaagagtacataggggtgaacacaacggaaattctcctgcgcagtaaaagttgcgctaaaggt

SEQ ID NO: 11345 - DNA, 467 bp, Homo sapiens
ccagctgcccattcttttgctcatctgtttaatttttaataaatatcaatgatctgagaggcattgggtagcactgaggatgcaatccgatgtgaacaagacttcaggagctctgctttcattaggcttacatttggttaatggagataaacttgaagcatataaaccaataaataaacaagaaaatatcagggagtgacaattgctattaaggaaagaaacagggtgataggatagagagggaggagagagacttcttcagtcagatgatcataaaatgcaagtatgattaagtcatggcctcaacttttaaggaatgatgggctcaccttgctttcattcttgccacctcctcaatgaaaatgaaagatgtttttgggaaactgatagctaattttctttttcttagaatatttgatttagataatatgtatttaaaataaagttatcacgtaaaataatatatt

SEQ ID NO: 11346 - DNA, 452 bp, Homo sapiens
acaggagctgtttaaagatttggacacaggctactaaggatgctcagaggtcatctagactaatttggtcaaaaatcagtggtacctagagtgtgtggccacttcttctcaaatatctgctgtaactagttcttgaccagtttttcccaccaaaactccagaactgatcaggtgtagtggctcacgcctataataccagtgctttgggaggccaaggcaggagggtttcttgagaccaggagttcaagaccatcatgggcaacatggtgataccccatctttacaaaaataaaaatagaaaaattaggtgtagtggtgtgcctgtattcctagttactcaggaggctgaggcaaaacgattgcttgagcccagaagttcaaggttacagtgatttataatcatgttactgcactccagcctgggtgagagagtgagaccttgtctcagggga

SEQ ID NO: 11347 - DNA, 120 bp, Homo sapiens
cttatcaaatgtatcatttatcaaatttaccaaatttattcatctttttaaataactggcttttgagttccttgattttctcagttgattccctatttttaatttcattgatttctgctc

SEQ ID NO: 11348 - DNA, 515 bp, Homo sapiens
ttgtctttggcactatgtgtggactttctgttctcttcttcatctagcagacattcatctactgctaccgctttttaaaaaagttattttatttcatattatgttttaatctctgatggagctagcttcccattgttgcacttctttttcacagcttcctggctattcctgtttgcttacttttcctagagaaatttagagtcagcttgtctacttgcttctcttctatcctcctaacctttctaataaaaataataagactggtatttttaaaaatagtattttttgtttttgaaactcattttctgcagctgttaaatcttttgaaatatatcaatgttgatttttctagactttgtttttttctggctaatctctgtttcttctgtcttagctttaagttttctcaggatatcatgatgccttgcagtatttctctttagctcttatgcataaggtgatagcattttaagatctcttgggtgaagattaggcctgcaaatatgagttctttt

SEQ ID NO: 11349 - DNA, 366 bp, Homo sapiens
gaacagaattaagtcatctcagctgaggccatcctagaccagccagctgccagctgaccaacaaagctcagctcagagaagccaaaccacccagcttatttttaatgcctattaaaaaaagttttattgaagtataacggatgcacaataaactatatgtatgtaacatgtacagtctgctaagctttgatgtatgtgtgcacgcatgagaccatgaacgtgatgaacgtatgtatccattatccataaaaattttctgaagccccttggtaatccttcctgctggtccctactggtccccaaccccaggagaccacttccatgctgttaccacacgttagttttcattttctaaattttgtatgt

SEQ ID NO: 11350 - DNA, 759 bp, Homo sapiens
gctcacacctcccccctccctactttcagcagatgtttttttctttaaatgcaagaagagttaactaaatcagcctttatatataaaaaaaagtgttttaagtttctcatagccgatgatcaaaaataccttttcttttgtgaattcaacaggggcactgagaaaagatacattataatgcgtcaaaggctacaatctagccattctttgactttaccttaaaacatctgtacaaatattcctgctcagtgtaagaaatctacctaagcagtcctaaacaaactgaactctgtttactttataaaagaaacagactgccacacaggtctacctagtccacacatcttcatcttgccaggcaaagctaatatcttaggcctaaccttcagttttgcggggggatctatagccagccccaccaaggggctgtgcatcacttgggcagaccagttcccggcctattagagaataccactgacacaaaacaaaagaaaaagcacgtatctccttatcacttagaggcaaggctgatttaggcataaacaaattattggccaagggaaccacagtataagcagctccgggcatcacagccgatgtaccagttcaaaagagagaagataaagtatttccaacacaaactttgcagaccactaggtctaatgattaaaagggctgactacgtgtcttggtttgatagagatgggtttgcagagcctgggaaacacagggagaccctgtctctaccaaaaaaaaaga

SEQ ID NO: 11351 - DNA, 563 bp, Homo sapiens
gcggccgcctggtggtggtggaggacctgcactctggcgcccagcagcactggtccggccactctgcggagatctccacgctggccctcagccacagtgcccaggtcctggcctctgcctcgggccgaagcagcacgaccgcccattgtcagatccgcgtctgggacgtgtctggcggcctctgccagcatctcattttcccccatagcaccaccgtgctggccctggccttctcaccagatgacaggcttcttgtcacactgggggaccacgatggccgcaccctcgccctgtggggcacggccacctatgacctcgtgtcctccacccgcctcccggagccggtgcatggtgtggccttcaacccctgggacgccggcgagctcacctgtgtgggccagggcactgtcaccttctggctccttcagcagcgtggggcagacatcagccttcaggtgcgtcgagagccagtcccagaggcagtgggggctggagagctgacctcgctctgctacggggcacctcccctgctctattgtggcaccagctctggccaggtctgt

SEQ ID NO: 11352 - DNA, 774 bp, Homo sapiens
taagctgggcctgaggcaggtgactggacctctctgactgtgtttcttagggagaaaagtccaggtgcactgtcctgtagctaaggcttttggactaaatgggtttaagaatttagaatttttccaaatttttttttttttttttttagactaagtctcactctgtcacccagactggagtacagaggaacaatctcggctcactgcaacctccgcctcccaggttcaagcgattctcctgcctcagccttcctagtagctgggattacaggcataagccacatgcccggctaatttttgtatttttagtagagacagagtttcaccatattggccaggctggtctcgaactcctgacctcaagtgatccaccaacctcagcctcccaaagctctgggattataggcatgagccaccgtgcccagccgaatttttcagattttagaaaggattatgctgctagacacagtgacactcctggaagggtgggtgcaacaccccaaaagcaaacatatagtactttcataggaaaacatactgttagtcaccctaaggaagatagttttaaaggccataattagtatcacatcaattcaggtcagatttttgcagcagaaattagtctgctgcagacttagaagaacctttgggatttctgagcgttctgaattctagaacagcagagaaggggatgtgggcctggaccgtcttccagaactgtagggaggctgatgaggaagcagacatccagtgtcgtttatttctatgtttatt

SEQ ID NO: 11353 - DNA, 379 bp, Homo sapiens
tcttcttacttttgactgttgggcatatggaggagtaccttaaagaccttcagtacagagcgagactctgtctcaaaaaacaaaacaaaacaaaaacaaaaaacaaaaaacctctggggatagggcccatctatctgggtttggtatagtgtgggggtcctcaaatctgagcttatcaggaaaatttggaggatctgttcatatagactggttatttaccacgtgccatatttagtgaaagttaaattgttgtggattctcaagaccagattgtgaaaggcagctgcactcaatatcaaattaacaacctgacctatttcttgaaatgtaaaacttaatccagagatcctctgtttaaacaataaaaatgtttactcta

SEQ ID NO: 11354 - DNA, 96 bp, Homo sapiens
aactctaggcagatgattaatactctagtagtcacttgctcacacagctggatttctcttctgaccaaatcaatacctaaagctagaactttctgg

SEQ ID NO: 11355 - DNA, 381 bp, Homo sapiens
gaagattgcttttacattttttgacactggtcttctaatcttgtttctcttcataaatcttgtgcaccattgtgattgctaagaagaacacaatctatttagcaaatgtttttggcataaaaggaatgataattattacttgacttttatatccttatagagacctaagctaaatctctgacactgacaatattgactattagccagcttgttaacagtactagaaatgaatttggaagaagcaatttgataaattacacacccttttggcttttaccctccctttatatcagacttgtgactgactcagaatgatatttggggaggtgaaaaaaggtaaacatgtttgagaggaattagccatcagactagagtgtattc

SEQ ID NO: 11356 - DNA, 433 bp, Homo sapiens
cacccatgacagggatacacagagtaccgtccctgtttgcaaatgaggaacatgaggccagagaggtgaaactcccagctgagaccagccagctaaggtttccaagccaggatttgatcccaagattgccccacttgaagctgccctgcacagcccacggtggccaacacctgctggaggctgtacaccaggagaccgggacgtgactgcccagcagagtagggactcaagaaatgcttgtggacagaatacccttgaatgccctgatgccaagcgctggaaatccagagacgataaaacacagtcctggctgtcaggagacaaagtgacgcgcctcatcacatgcaggatgggctgtcccaagaagcccatggacggcctgaccacgccttgttgtgatacaaaagagagagagagggaggggacttcaagc

SEQ ID NO: 11357 - DNA, 446 bp, Homo sapiens
ggctgaccttgggtttaaatcccagttctgccacttactgtgtgaccttgggcatgtcatctaacttttaagtctccatttctttgtagtatgaatataatacctacagtgcagggttgcgaagatttaaaccaaatgtagtgaaagtacgtaggacatagagggcactttgcatggtcacaccttctccacttgctgtccaagccctgtgccctaggtgggaagagacaggcaagaaacgtaaaaccctctcctccaggaggtggagctgccatcgagatattttagaagtgaagatgccagaacagggtctagatagctcatggccctcaccttcaccccagtgcacacacaaacatcaccattcaccctcctattacattatcactcctctggggatttattctttggttaaacacttcacagtcagagcacagaatccctga

SEQ ID NO: 11358 - DNA, 790 bp, Homo sapiens
  misc_feature (457)..(457): n is a, c, g, or t
  misc_feature (464)..(464): n is a, c, g, or t
  misc_feature (511)..(511): n is a, c, g, or t
  misc_feature (517)..(518): n is a, c, g, or t
  misc_feature (533)..(535): n is a, c, g, or t
ggggaggtcgtgatggcggcgccggaggcggaggttctgtcctcagccgcagtccctgatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccgaaaaccttctccccaggcagaggagatgctgaagaagaaacctcgggccaccactgaggtgagcagcaggaaatgccaacaagccctggcagaactggagagtgtcctcagccacctggaggacttctttgcacggacactagtaccgngagttgntgattctccttgggggcatgccttaaggccccaaggagttctatganctcganntgtctctgctggccnnnacaggtggaccagagctgagcacagcagcttgtttgccgccgtctcttccgagccatattcatggctgatgcctttagcgagcttcaggctcctccactcatgggcaccgtcgtcatggcacaggaacaccgcaactgtggagaagatcggtttccgaccaagctcaatatcgagtgccaggcggggcataaactgactgggacccgtcatgggggagacttccatcgaaccacgcttgggaaaacacacattgg

SEQ ID NO: 11359 - DNA, 146 bp, Homo sapiens
acaaggcaaaaacagagggtgactctggacttaacaaaaggagtcctcaggctcaaacactagttaaccttgttcatcacacagagaaggaaatcacatgggtatttgaggccaaatagtaaaagagtatgcaattgcctggatgt

SEQ ID NO: 11360 - DNA, 331 bp, Homo sapiens
aacaggtaccattttctccagatacttccccttcatctgtcctgaaattattaattattgacttctacttaaataagatcttattttcatctgctggaaaactttttctgataaccatacatatcttcaatgtctacaatttgaatggagagccctttcaatgtggcgtttctgtttcttccataacctcacaacgatatgtggtggccccgcagtcattatggtcttgttaaataattagatttgtgtaaactatattttagagtcttccaaaacgcctctccttccaaaatggctaaaagggcaaagcgtcagtaattctgtagacatg

SEQ ID NO: 11361 - DNA, 1094 bp, Homo sapiens
atgaggaacatctgaatcacctttataaattagatccttataaaaatcattgagttttctcacattaaggaacactgtagtgcttatagcttgtgatgtccagggagggacttagttggatatatctataagcctccatgctagctttttaaaaataattgtataatagagaaaaaatatatgccaaatcttgtgaaaccaggttaaaaaattagtactatatgcaagacatgcttcccagaatattagggctagaaaggaacagtgtttttcaaagttccaaagcatagaagcttttagaaatgaactcttaatcaaaactccagtttgtaaaaccaataaaagcagaatcctggaacccacattacacatgcctttcctcttgagggtcccccaggagtgctagtctccacatggcacagatagaatgtgtgagacttacctgagggacacaggaaaggggtgccagatttggaactagaatgcaggagaccatggcgctcaccaccatgctggtggctctgccccgttcgtcctgaacacgacttagtcaggtatttggtcttttgagttaaacagaccctggtgatgagctctttgccttggacagattactttacccctctgattctcagctttctcactgggaaaagcagacctgcctcaggtctgattcaaggattagtcagccttagcatactttaagtacttcattattattattactactgctactactgcccaaaggccagaatccgtggagccttaaagacgcagaactcaaactgtttttggttaaatcatctttgtctcagtcatgggagtggtgtacaaatactccaatcagtttagattcatgcagcctttttatctgttgatgcttcttagccctaaagttgttaatcggtttgttttcttagaatttagaggaatttctaggttatttgaatactttagatactttaaaattttgaaagctttccagggatgttttcactggtgcctttaccttctttgagtccagttcccactaggaaatggcagcattcacatgattctgtgaccccagtgaagcaaaggacctagtattgagg

SEQ ID NO: 11362 - DNA, 916 bp, Homo sapiens
tcttttaatgttcgacactctcgttgaagatgtgaatatctgtctgcaggcatgcagcagtctacatgctctatcctcttccttgccagatgatcttttacagagatgtgttgatgtttgccgtgtccaactagtgcaccgtggaacttgtattcgacaagcatttggaaaactgttgaaatcaattcctttaggtgttttcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttctaagctgagaaccccactgggcagagctcaagacaccttccagacaattgaaggtatcattcgaagtctcgcaggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcagggaaag

SEQ ID NO: 11363 - DNA, 1971 bp, Homo sapiens
atggctatgagttcttttttgatcaactcaaactatgtcgaccccaagttccctccatgcgaggaatattcacagagcgattacctacccagcgaccactcgcccgggtactacgccggcggccagaggcgagagagcagcttccagccggaggcgggcttcgggcggcgcgcggcgtgcaccgtgcagcgctacgcggcctgccgggaccctgggcccccgccgcctccgccaccacccccgccgcccccgccaccgcccggtctgtcccctcgggctcctgcgccgccacccgccggggccctcctcccggagcccggccagcgctgcgaggcggtcagcagcagccccccgccgcctccctgcgcccagaaccccctgcaccccagcccgtcccactccgcgtgcaaagagcccgtcgtctacccctggatgcgcaaagttcacgtgagcacggtaaaccccaattacgccggcggggagcccaagcgctctcggaccgcctacacgcgccagcaggtcttggagctggagaaggaatttcactacaaccgctacctgacacggcgccggagggtggagatcgcccacgcgctctgcctctccgagcgccagatcaagatctggttccagaaccggcgcatgaagtggaaaaaagaccacaagttgcccaacaccaagatccgctcgggtggtgcggcaggctcagccggagggccccctggccggcccaatggaggcccccgcgcgctctagtgcccccgcacgcgggagccacgaacctcggggtgggggtgggcagtgagtgcaggggatggggtggggggacaggagggggccctggggcctgggccccggaaaaatctatctgccctcccccacactttatatacgaataaacgcagaagagggggaggggaagctttatttatagaaatgacaatagagggccacggggaggccccccccagaagcaagattcaaatctcttgctttctttcttaaaaaaaagaaaaagaaaaagcaagaagaaggaagaaagaaaaagacagaaagagaaataggaggaggctgcagctcctcgttttcagctttggcgaagatggatccacgtttcatctttaatcacgccaggtccaggcccatctgtcttgtttcctctgccgaggagaagacgggcctcggtggcgaccattacctcgacacccgctaacaaatgaggcccggctcggccgcctccgcctctgctactgccgctgctggaagacagcctggatttccttctttgtcccccactcccgatacccagcgaaagcaccctctgactgccagatagtgcagtgttttggtcacggtaacacacacacactctccctcatctttcgtgcccattcactgagggccagaatgactgctcacccacttccaccgtggggttgggggtgggcaacagaggaggggagcaagtagggaagggggtggccttgacaactcaggagtgagcagggaaattgagtccaaggaaaaagagagactcagagacccgggagggccttcctctgaaaggccaagccaagccatgcttggcagggtgaggggccagttgagttctgggagctgggcactactctgccagtccagagttgtacagcagaagcctctctcctagactgaaaatgaatgtgaaactaggaaataaaatgtgcccctcccagtctgggaggaggatgttgcagagccctctcccatagtttattatgttgcatcgtttattattattattgataatattattattactatttttttgtgtcatgtgagtcctctctccttttctctttctgacattccaaaaccaggccccttcctacctctggggctgcttgagtctagaacccttcgtatgtgtgaatatctgtgtgctgtacagagtgacaatagaaataaatgtttggtttcttgtgaccagca

SEQ ID NO: 11364 - DNA, 1770 bp, Homo sapiens
atggctatgagttcttttttgatcaactcaaactatgtcgaccccaagttccctccatgcgaggaatattcacagagcgattacctacccagcgaccactcgcccgggtactacgccggcggccagaggcgagagagcagcttccagccggaggcgggcttcgggcggcgcgcggcgtgcaccgtgcagcgctacgcggcctgccgggaccctgggcccccgccgcctccgccaccacccccgccgcccccgccaccgcccggtctgtcccctcgggctcctgcgccgccacccgccggggccctcctcccggagcccggccagcgctgcgaggcggtcagcagcagccccccgccgcctccctgcgcccagaaccccctgcaccccagcccgtcccactccgcgtgcaaagagcccgtcgtctacccctggatgcgcaaagttcacgtgagcacggtaaaccccaattacgccggcggggagcccaagcgctctcggaccgcctacacgcgccagcaggtcttggagctggagaaggaatttcactacaaccgctacctgacacggcgccggagggtggagatcgcccacgcgctctgcctctccgagcgccagatcaagatctggttccagaaccggcgcatgaagtggaaaaaagaccacaagttgcccaacaccaagatccgctcgggtggtgcggcaggctcagccggagggccccctggccggcccaatggaggcccccgcgcgctctagtgcccccgcacgcgggagccacgaacctcggggtgggggtgggcagtgagtgcaggggatggggtggggggacaggagggggccctggggcctgggccccggaaaaatctatctgccctcccccacactttatatacgaataaacgcagaagagggggaggggaagctttatttatagaaatgacaatagagggccacggggaggccccccccagaagcaagattcaaatctcttgctttctttcttaaaaaaaagaaaaagaaaaagcaagaagaaggaagaaagaaaaagacagaaagagaaataggaggaggctgcagctcctcgttttcagctttggcgaagatggatccacgtttcatctttaatcacgccaggtccaggcccatctgtcttgtttcctctgccgaggagaagacgggcctcggtggcgaccattacctcgacacccgctaacaaatgaggcccggctcggccgcctccgcctctgctactgccgctgctggaagacagcctggatttccttctttgtcccccactcccgatacccagcgaaagcaccctctgactgccagatagtgcagtgttttggtcacggtaacacacacacactctccctcatctttcgtgcccattcactgagggccagaatgactgctcacccacttccaccgtggggttgggggtgggcaacagaggaggggagcaagtagggaagggggtggccttgacaactcaggagtgagcagggaaattgagtccaaggaaaaagagagactcagagacccgggagggccttcctctgaaaggccaagccaagccatgcttggcagggtgaggggccagttgagttctgggagctgggcactactctgccagtccagagttgtacagcagaagcctctctcctagactgaaaatgaatgtgaaactaggaaataaaatgtgcccctcccagaagcaagattcaaatctcttgctttctttcttaaaaaaaagaaaaagaaaaagca

SEQ ID NO: 11365 - DNA, 497 bp, Homo sapiens
tatccatattatattttatattccattccattatataccagagtatatttaccaattttcttgttggacattcaggtagtttccttatttttgcaattatgagaaggacagtaaaaaaaaattcatgaacacatgccagagtttttctagaagtgtctctgctaggccatagggtgggcagatgtttaccatatgagatagtgccaaattatttcccaaagtgtgtgcactgctagcaatacataagacattgtattgacacacatcctctcaaacttgattttctttaactcctgggagcagggactatgtttcccgttttttgaaacagaaatcatagtactaagatgaggtaggtacactatgaatccttgttcaatggaattaatttaaaatttaaaaaaaggttgaagagccatatccctttcataggaatgacagttcagaaattggggaaaaataaagaaggattaaaagtgagtgaatttcatgtagca

SEQ ID NO: 11366 - DNA, 357 bp, Homo sapiens
gcaaactaacaatttatcacaaagacaatgtgatgtattcatacaatagaatattattcagcaataataagaaatgtacaacagatacagcaataggaatgagtctcaaaaaccttctgcttagtgaaagaaccaaggccctaagagcaaataactgtgtgagtccatgcatgtgaagttctaaaacaggcaaactgggagagggggtgagtagaggaaattgcctgggagcgtccaggggatcattggggtaaaggaaatactctcagaaatgtaacaaattgatgcccacttcacactgtagatcaattcagtggaaatctctcgggtgattccagtgtgcaaccagtttgagaa

SEQ ID NO: 11367 - DNA, 599 bp, Homo sapiens
aggtaattatttgaagacttattgtacttccattatggcccttgctcatctacagtaccttctaggaggatatatttgccaatagtctctactgtagagccagctcttaggcagccatgttctgaaccatgtgactccaccctctagccacagtggaacaaactggaagttggcacctgacccaaaagaaaccaatctgtcacaatggctagcaatccacgtcatgtgaaaaacatgaatcgacccaatcagatttcctcagtttgaaactagaactaagaagtaacgagaaaaagatgagttagtgagaaccaaagctagaaggattctatgaggtttgtcatgacaagctaaagtcataaaggaacataaacacacggaaaagattcacagagagagaggaaggcagaagatttttgtttttgtttttgttttgtttttttaagaggtaatatgatttcttaggctttacaaagtctttctaggtccacttctataccttgtttgtttttataataactactatccccttttatcttgaggttatttaggtgaatctatattctttgcagttagaggcctattagagcactctttaa

SEQ ID NO: 11368 - DNA, 779 bp, Homo sapiens
ttttttcattctgtagcaataaacagggaatatgttatttattatataagctaattaatatcatggcatttaatgtctctgttcatcgataggctgactccagtttactcttaggagaatttcagattggttcctactcttagtcctgatacagattatcatgatggacaacttccttatttaaaaaatgtttttaagtggggagaaaatggggctataccttaacctacatactaaatgtttctttaaggttgtatgtacatagtataactgttagccaaacattctttaagtacttcagaaagttactgtttaaaggaattgtattgtgaagcccattataaatggaaataatcatcttcattttatcctactcggtagaaaaccagagccaaaggccagtggtccaaagttctagacctcactctaccactaattttctgtatgtctttagaaagttacacaattttgtgaatcttttctcatttttaaaatgagataaactcttaggtgccttttttttttttttaaataacttttacttctaaagttgggttacatatgccagattggtttaaaggtagtacaccaattccttctagaatggatgttctcaacctatagtaaataactgatgatccggcattttaagtgtgcagatagattcatcggcaggttccatgatggttgatctttctctgaccctttacgaatgttaagagattaatttgctaagtataaactgaatattattaaattttaatggtatttactattga

SEQ ID NO: 11369 - DNA, 369 bp, Homo sapiens
gtcacagttgctttgactatagagtccctatgtagaaatagaattatcctattctttttttggcaacctcactgatttacaatgaaattattggaatggtcaatagatacatccatatagcattttgacataagcaaaatgtaacttgactgaatagtaaaataatactgtaattttttatttccaatttcaaagattattttaaagaactgaggagatgatatattatgttgctatgcattggcaatttctggtaggaagttagggggaagatcaactcaaattctgaaactttactccattataaacttttctacatcctattagttccaaatatgcagaaagggattgtgcagatgataccattct

SEQ ID NO: 11370 - DNA, 1689 bp, Homo sapiens
tcacttaataatgttagaaaagaaccttgggttaaaccctggaaaagtgagcttgcagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtgtgtgtgtggcagagagagagaaagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatacatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaaca

SEQ ID NO: 11371 - DNA, 705 bp, Homo sapiens
gccagctggtcaggctcaggttgaggtacttggcttaacaagcaaagtcacttaataatgttagaaaagaaccttgggttaaaccctggaaaagtgagcttgcaggtctgggtctgtttccttattcagcaatgggcagtaagaacatagagtgatgtcactcagcacatgcctggcccataactgtcttctttgatgcctgtttttttctgtttgtagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtgtgtgtgtggcagagagagagaaagagagaga

SEQ ID NO: 11372 - DNA, 4645 bp, Homo sapiens
gaattccgggcagcatcatcaaggcacatagattctctctttgaacaatgcagctgctgcaggggatggggaagggatggcactggcaattcaagactgcctttcctacttcttcagtgcctctttcaccaatatgaagttaaaaccaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttacaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctcaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtgtgtgtgtggcagagagagagaaagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatacatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaaca

SEQ ID NO: 11373 - DNA, 2073 bp, Homo sapiens
gtgattctagaggatctcatgaatgtttgctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctta

SEQ ID NO: 11374 - DNA, 1436 bp, Homo sapiens
agttaggagtctgagactagcctgggcaacatagggagcccctgtctttacaaaaaaaaaaaaagagagagatagccaggcatggtgttgcatgcttgtattcctgcctacttgggggactgaggcaggaggatcacttgagctcagaagttcaaggttaccgtgagcaatgttcacgccactgctctccagcctgattgacaggccagaccctgactctaaacaaaaacaaaaaacaaatatttaagtaatttccaaacatagcagaaaatataagcatggtttatcactttgatatgacaccaacagctacttaagatagaatcatgaattcagtaaattgttgtgtggaaagctaaggtgccaacccaagccgcatcttcttaggtgctcctcactggtgtcatcagctacagcaggcagagcattgccaggagctagctcttcccttcaagaacaaaagtcttgtttaagagcacagtagcccacaacttgctctttctcctgcagtctcttttatttccctcctttcttagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctta

SEQ ID NO: 11375 - DNA, 1502 bp, Homo sapiens
caaaagcagttgggccgaacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttggtaagatctgcacccctaaattttcctgctagttttccccctgagattttgctttattttttgcgctggtaccttagtgaccctagtgcctcaggatatgtgtaggtgaaacagaagaagtaggctacttttctgttctttctaaagagagctccaaattattctcttgtctttcagga

SEQ ID NO: 11376 - DNA, 497 bp, Homo sapiens
cacttaccttcccagatggatgcacattgcctgcaggtctttacattcttttcctaagcagttcttagaggctatgggatcctggagaccacagtgacaaagattagtgagtctcttagcacttggagaagtcaaaagataatgctaacatgtgacttaggttttatcacctatgaggagctcagaggataatgctttggtcagacatgaatttcaatgactttcccaaaggcacatagccagttgcagcaaagctaagcccagaatccatgtctctggaatcccagcccagggtctcttccattgtgggacatcatttttatagataatctttgtttggctcagtttgagaccgagctgaaacatcatggaaaatagcaccagcatctttatctgaaagaccaagggggatctttggcctcatcatcataatatcacccttataaatattacacatttaatagttaatatagagccttcagacccattatctcatt

SEQ ID NO: 11377 - DNA, 2357 bp, Homo sapiens
caaaagcagttgggccgaacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctta

SEQ ID NO: 11378 - DNA, 2217 bp, Homo sapiens
aaagtggtatcctgggcccaccagtttttctacactcacccactctggtttgaaccgttcactggcttccagaacatttgagcccaactatgtcaaagctgtgtgtagccacaggggtgaggtgttcttgggagagctgctcttcctgagaacaaagggctcaggctatgatgtggggaggaggcctggacctgtgtcctatgcctgggcagctgaagttcccaccctgcttatcaaggtgcctcctctgggaaccccctagtctctatttgacccaaccaacttcttcacttgcagaacctcaagccctaatatgtatgacttcttcctccagtggattgtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttgtaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctta

SEQ ID NO: 11379 - DNA, 1158 bp, Homo sapiens
  misc_feature (19)..(19): n is a, c, g, or t
ggctggtacggtcggaggngttaggatcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctta

SEQ ID NO: 11380 - DNA, 2479 bp, Homo sapiens
tgcggagctgccgccgcgcgccggtggggcgcgagcgtgtgcggggtccgggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccgg

SEQ ID NO: 11381 - DNA, 999 bp, Homo sapiens
tgcggagctgccgccgcgcgccggtggggcgcgagcgtgtgcggggtccgggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccgggcacattgcgtctttgctcggaagatcttcttgagttggtgagaatgcagggccgagtagccagctgcattgcttagatttgattcatgtcacagcataaattgtcttgattccaaatcctaaaccagg

SEQ ID NO: 11382 - DNA, 868 bp, Homo sapiens
tgcggagctgccgccgcgcgccggtggggcgcgagcgtgtgcggggtccgggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccgggcacattgcgtctttgctcggaagatcttcttgagttggtgagaatgcagggccgagtagccagctgcattgcttagatttgattcatgtcacagcataaattgtcttgattccaaatcctaaaccagg

SEQ ID NO: 11383 - DNA, 2140 bp, Homo sapiens
tgcggagctgccgccgcgcgccggtggggcgcgagcgtgtgcggggtccgggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccgtgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccgg

SEQ ID NO: 11384 - DNA, 2592 bp, Homo sapiens
tgcggagctgccgccgcgcgccggtggggcgcgagcgtgtgcggggtccgggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttcagacaaggtagagccgagagacaaggtagagccgagagacaaggtagagccgagagacaaggtagagccgagagacaaggtagagccgagagacaaggtagagccgagagacaaggtagagccgagagacaaggtagagcgag

SEQ ID NO: 11385 - DNA, 996 bp, Homo sapiens
tgcggagctgccgccgcgcgccggtggggcgcgagcgtgtgcggggtccgggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccgggaagagttgggctgtggggaccaggggcatcaaagggcctttgggaagggcacggcatgtgggggtggctgacctttagctcgatggtcctcctccttggggcaccgccacccgcggagccttgta

SEQ ID NO: 11386 - DNA, 164 bp, Homo sapiens
gatttagctgatgcacactcttcaccacctcccatacttcaatgcttttttcactttttttggttgaattactatatggtttgttattactcttacaaatgagctagccagggtagtatgattgcattttctttcctatacaaaccttttgttttccctgaagt

SEQ ID NO: 11387 - DNA, 390 bp, Homo sapiens
atcttgagttgtataaagatatttgagcaggtgtcttttacaaaacagcagaattctttactgaagctataaaataaggaaaagtgcataaatttatagttcaacaaactgtaaagataattcttgtaaaaaattttattccactaaaattactcatgattttcctttccaaagataaacactattaccatcttgatttatagtcctctagtctttttaagcatagatttatgcacaaatctagatgaagattgcatataaacatatgcattcatagcaccgccactcaagtcaagatatggtattccttactaattgcagtcccctacctcggtctattattctgacatgtgtggtttgaaataatgctttttaaactctttttcatca

SEQ ID NO: 11388 - DNA, 682 bp, Homo sapiens
ccaccgtgcctggccaggatttttaatctgtgtaattcggacagtgtgattgcctgtgttgaggaaacccagttactcagtgatagattgtttacacgtgagaccagctctcccatgtcaactgaatatctaaacacaagttacttctaacattcaaggaaacaagtcagtattttaaatagccaattcattgtataaaaatagaaactgatgttttcaaaggtgacttaaaatagtatttttatgaaaaataagtgtagacagttctagagagtagcaactcgtacattcatgtatgaggttctgtgtggaagtatgtcttcatacatacccatggcccggcctcagtgagcaagcgaggcgggcgctgttagctcagggctccttgtttgatctgcgcctttacccagtcccttcctgccatgatttcatagcgcattctagacatactttctctgtaaatatctcactctgtatctccaaaagataaagactttaagacacatgaccagaatgtcattttcacacctaaaactctcagagattccttaatatctctatccggtcagcattcaaacttctccaattgtctgagtttaagaatttgttcagggagtccagattcagggtgtctcatgtcccttttccccatagggtgctccttggagcttgtgtgttgagg

SEQ ID NO: 11389 - DNA, 317 bp, Homo sapiens
aaaacaaaaaaacactatctgtagatacactgacattacatgaaataagatacagtttctgatttttttcttttttaagttacaatctaatttaaaagtgtgtgttcaccagggaggcagtgcaggggctcactgaggcctgttaggtgtggccctcccctccctgggcaggtcagatctgagcaccttcagctgcagggccaccaagctccctgtgcaggtggagccatgggtgcctgcaccgtagctgggcaggtctcggcagccctccttgtccccgtgctcgtatttaaacttgcagccaatctcctcttctc

SEQ ID NO: 11390 - DNA, 462 bp, Homo sapiens
actgccttaaccactattgctactggaactgccttagccaccttggtatcgtggtttggcaaagtattggcctctaccaccatagggcccagagcttctgcctccaaagtttcctcccttcatgggtccaaaatttgaagactgattgttgtcattgccaaaatcattgtagcttttaccacctccaaaattgcttcaatcattaccaaatctattatagcaatccccactgccaccatatccatcaccaccaccatggctgccaccaaagccaccacgatcacagaacttgatgactgtatttgtgactaattgtataatagtttctgttctgtggaaagtaaagcattccaacacagggtttcagtgtagattgttttgttttgtacccatgctgttgattgctaaatgttttaataatctgatcatgatactgaataaatgtctttttttttttttaac

SEQ ID NO: 11391 - DNA, 642 bp, Homo sapiens
ttcatgaagcagagaaactcatgttttaagtcaaacttggtcctcatctttttcttttatcagtggaaatctaagttcaagtttaccttgtcctacactgcaaatgttatagaccatttttgtttgtcttttactgtgctaagtgcatggaacattaaaggaaccctaggaagagattcttcatatgtggctcagttgaagagaagtacttatgtagttctaagtatttttattagatagtgtgcaccaactctgtagaaacacagaattttgttggaaaaaggaacttagtttttgtaacatgttcattttactgctcaaaaaaacgaatgctgaaagatttaatgacttgcctacagttactggtagaaccaagtgaccgaagctctgtcttcaatattttgtgtctctgtgccatcctatcccccttatccatctttacacccccagcccccaattaaatataggcaattataatagttcagttgtgcctcttcagtatgggtctgagtcctgtcagtgtgggcatatctgtggtcttttaaaaaataaatctctcagtatttttcagagtaggctattagcaagaagtaggctataaacacaggaaaccagtgactgccccttttcatggaactgatg

SEQ ID NO: 11392 - DNA, 218 bp, Homo sapiens
cgggaggcagaggttgcagtgagccaagagagagccactgcactccagcctgggtgacagagtgagactccatctcaaaaaaaaaaaaaaaaaaaaaagaaaaagtaaaaagaagaggtgaggaagtgggggcagatggaaggccaatgtaaggacctgggcttttactctggggaaacattggaggattgttagtagagaatttaactgaggtttca

SEQ ID NO: 11393 - DNA, 322 bp, Homo sapiens
tacttaatgtcatatacatcttctcagtgaatagagagagacctgattccttttcatagctgcatattattccagtgtgtgagtgttatttatagttttccctgtgacctacaatgttgcaatgaataatctactaaataatttttcatatctcatatatttgtgagataaattcctagacgtagaccttttaggtcgaacagtgtgtgtgttgttacatttctaatgagcaccccattctcttctctgcgagaagtgtgatttgaagatgtgcagggaagaggaacgtgtaggaagcggcacatgcagagatcactgctgg

SEQ ID NO: 11394 - DNA, 848 bp, Homo sapiens
cttatattcagggatgacgtatctcatggaagaacagggctcaacgagccacttaaatgtcttcctatcaaatgttaaggttctagaaaccaaatggtgggtatattatccaacatatgccgtgaaagcagagccaatcctgggggaaagcttctctcctaatggtaaggtgtccatatcctctgccccaagaaccaagacaagtgatctgacaagtgtgaagactgcttttcaacatgaaaaagagttttcttaaactcaagcatgatattggctctactttgaatatcagttacgaaaattcataacgagctgaggtatcttcactaacattgcaaattaatttcttgtattcatcacaatgacatttatgtgtatttgaaaagtaatccatatggatgagcatatttttcattcactctacagacggaacatgcacgctggtttgcagatcccttgcagtgactctacagctcccaggaatctgaggttcacaaggtgaaacctaccaggccaaacaatttaaaattggttttgttttgaaaatccagtaagtatgatggcaatgtcttgcagaaattcctcttttagtattccagtctgtgggctctggcagaagtaatagtctgctgcaaacagatcactcttttttgtttgcaaagtcttcgtaccagctgaatcacagcttgcttttcacttttcgtaacaccttgcaacatcgcaaaatatttgctggagtttgtgaagggcggctgcagaattagtaaactgaaaggaggccttcctttactcccacccctcccttccagctatgtgtacaattaatgaccaatctgtttgggctaaaa

SEQ ID NO: 11395 - DNA, 482 bp, Homo sapiens
taaataatacagtctatgtttttgaaagtttgttcctgaagtttctttccttcatttaacattgtctaatctgctttctcaacaccaattcaacacaggagcatgggagagccaagttaaataagcacgataattctgctggaaactacatatagtctgttgcgtagaagcatacagtaaacattctgcaccgagcactgtgtttcatccccagcagatgacattccttatgactttatatcccatgggctaaattgattaatataatatcgaactactatttgtgtattttgcctaattgcccaactacataaatcattatgaggcaagaggggacggttttttttccttcttactcacaagcctgctgcttttctgaccttgccacggattagcgaggagtaaggttgtaaatgcagagctggcaaatgtcttccgaaggcaattactgtgaaactttgttctaacattatgaaatgcgg

SEQ ID NO: 11396 - DNA, 375 bp, Homo sapiens
tctttgggtactgataattttcaaagaaaaacttatacaaaagcagaattattattaagactatattgaataaatttgtttttgatgattcagaaagtttaacagaatctgaccctatcctagtcatcattaggaccactaattttcttgctgataatatattatgtaaaaagcaagggttacaaatagtacgtatagtatgatctgaattttgcaaaaactacatatataaatgtaaaacagaaatcggaaaggtatacattgaaatgtaaataatgattgtgtctaggcgttggggatcataattttaattttttatttattattttattttattattattttttaggggcagagtctcactctgttgcccag

SEQ ID NO: 11397 - DNA, 2566 bp, Homo sapiens
  misc_feature (200)..(200): n is a, c, g, or t
gtgtggtgacatgattgtggccgtaaatgggctgtcaaccgtgggcatgagccactctgcactagttcccatgttgaaggagcagaggaacaaagtcactctgaccgttatttgttggcctggcagccttgtatagattttggaaattggtttcaaatcttgcatcttccttttttagatttttgaaagaaaaccctttngtttcattgtgtttgtggtttaggagctgctgacactgctggtatacacagggccaaaacccactaagattgtccgtttatgtttatttaaatggtttcctaagttagttacatttcttttagcttggaaacagtcttccactaacctttgtgagtttatattttcagaattcagacttagttgttaaaatgttacctatggtaatgagcaaagctcacccaaactgtgccccagatggagtaaagaccttctggtgggtctttgttttcagtaactgaatcatagaacgagttctgtatccctcaggcctgatgtcagcaaagccagtaacaacagcgtgtactgccactgtcataaccaataccatgaatgaatatactttaaattttggtgataactgttccccatttttttttgaaccacagtctcactctcacccaggctggagtgcagtggcacaatctcagctcactgcaagctccgcctcctgggttcacgccattctcccacctcagcctcccgagtagctgggactacaggcgtgcgccaccatgcccagctaattttttgtacttttagtagagacggggtttcaccgtgttagccaggatggtctcgatctcctgaccttgtgatctgcccgcctcagcctcccaaagtgctgggattacaggtgtgagctgccgcacccggccgttcccattttttattggtgccaacatttcaaaacttcatactgtttataaactgattttctggtttatttctactgtaatctctcaatattcatagaagatgaagaaataagtctgacaacactaaagaaatttcttaatatactattattagaatagtagaggataaaagataatgttatccagttacaaaggaatttggatgataattataacttaatgttagagatggtaaagctgcacttacttgaacagcccaaaagcattaaaaatctatttccagaggaatgttttgctatgtagggaaattttgaagtagtttttgctaaaaaattatttctagagttgtgttattcttagcagtaatcttggctagaaatgtttttgtgatttatgcgattaaacgaaatgataaagataaaaccatattattaaatacctatatatcacagctaagtaggagaaagggagacctttttattttgttcaggtaggagtatttcttgtgtattttagaaacaattatttttcccattatttcttatgagattagttgtttcaagtaggagacagaaaagttctgttttgttggaaatgtaggttttagatgtatctttcagtcagctctcagtcactagactatttcatattttttgaaatgtttttgaaaattatgactagcccattttttgtcctttattcaacatacttatcctctgaacacataaataagtgaataagataaaaatatctttaccttattaatattatacatacttgaaaaaaatttcatttagaaacctagttcagaatctgagcaaatttacaagtgacctctgtaataaatggtattgataatcagagaatgtatttcagaatactacagtacaatatattatgaagcatgaccactttattttgaaacttagcaattgtattgctggggtttattgtatctgtagcatgtcactgattatttcagttagttttataatgatttttaaaaaacatatctatttggaataagatacagcaacaatcattgctactgacttgttcaaccccttagttacactgtatgatcaacatataacaagatacagtggaatggcccatacagtatattactgttgtgtgatgatggctttggaagcagttgattttgaaatgctttgatattctaattgacatggaacaagttttttccctgctccccaaatagaattttgtaaccaactttgctatttttttaaagtttgtaagaatgtgtcatttcttggggagtagccatccatcaacaaatatcctgactgctactttgttatatacaaaatacttacattgaacctggtggcataatgagtattttgaaagaagaaatttcttcactctcatttttatagaaatcttggaatcagcttaagctgtagcttttatgacaaaagacagtcatttttggtcagagtgatatttggtgacggaaacttgttcataatttattgttactatagaactatttggattttctcatttttagttctgatagttaaatattttggtttgttctgtgccttcagtttaaattatttcaggatttttcagatgtttaaataatggtgtgaatcattcaggatggaaataaaagtcatcctttctgtaaaaaaaaaaag

SEQ ID NO: 11398 - DNA, 319 bp, Homo sapiens
caggcacccgccaccacgcccggctaattttttcgtattttcagtagagacggagtttcactgttgttagccaggatggtctcgatctcctgacctcgtgatccgcctgcctcggcctcccaaagtgctgggattatgggcgtgagccactgtgcccagccaaggttaaaagatttgaattttaatgataaaattagggatcttgaagtaggactgtcaagaaaggaacttgtgattgtgggtaattgacctgtgttgatgacagcacaatgttactgggcagagtaggtgagaaaaatactgaatattatcaaggaag

SEQ ID NO: 11399 - DNA, 315 bp, Homo sapiens
atataataatgttagcagtttatcctagaatttgttacaactaataggtaagatgatgaaaacattggtctcctcctgaaattgtataataaataaaatagtctatacactaattagaatgtaattatatatagcaaccaaagtttatgtaatactttgggaccaacaacaatgatttgtataataataaaatatttcattataaaatttaaatatacattctagtagagtacaagaaaaaaatgtcagatcgagtgaaccatcatatgaaccaccaaatttagcctcacactaacagaagaggaagacttattt

SEQ ID NO: 11400 - DNA, 428 bp, Homo sapiens
gtgctgagtcatgtaggagtgtgtgcttttttgaatagtcatgctgaagtatttaagggtgaagagttatgctatctataatttactctctaaaatcataatcactctgtgattttccctgtatacacgttaataaatttgtatgccttttctccaattaaaaacaatactgtaatcccagcactttggaaggccgaggcaggcagatcacatgaggccaggagttcaagaccagcctggccaacatgataaaaccccatctctactaaaaatacaaaaattagccaggcgtgctggtgcacatctgtaatcccagctactcgggaggctgaggcacaagaactgcttgagcccaggaggcggaggttgtagtgagctgaggtcatgccactgcactccagcctgggcaacagagagagcctctgttt

SEQ ID NO: 11401 - DNA, 460 bp, Homo sapiens
accaaaaataaccatatgggccaggcacggtggctcacacctatcattccaacactttgggaggtcaaggtgggaagattgcttgagcctaggaatttgcgaccagcctgggaaacatggcaaaatcccatctccacaaaaaatacaaaaattagccgggtgtggtggcacatgcctgtagtcccagctactcagaaggctgaggtgggaggatcacctaagcccagggaggtcagggctgtggtgagccatgaccctgccagtgcactccagactgggtgacagagtgagaccgtttcaaaaaaataaataaaaaataaaaaatattctggttatatttattgtattgcacaaccatatgaatttttcatctactgttctgagtaaatttaattgtgtatccatatgcgataagcggtgtattccatcttaaattgaaatagtggcaaatgtaaaaata

SEQ ID NO: 11402 - DNA, 582 bp, Homo sapiens
ggaagctggtaagccttgccttttatacacagttctgaattttaactctgaggagaggagttttttggggtataattctgtgtcgtaagaggctgccctatgtgttgtaggatgtttagcagcatctccagcctcaacccactcgatgccagtagtatccagttgtgacagctaaaaatgtctccagatattgccaacagttgtcccaggatgagaaccactgctgcaaaggtcacacgatgtggttgggcagggtgagtatgggaccttgagctggggtaagacctgaggggcagagttgtgagagttatggggaacgtttccaatttcttctatggagaaatgggaagagatggtggatgaaggaaatggagtggcatggtgggaatggagtatgtaaattcctaaaagagaaggaaagaatcctaaaggctgaaataattttttaagacagtagataaaaagtcatgtagcatttaaggagacttattttttctagaaggttgatttatatgtttattgagagggaaggaaagttagttaatcagaaaagaagggggaggtggggatggtaaatgagtt

SEQ ID NO: 11403 - DNA, 779 bp, Homo sapiens
gtgtgtgtgtgtgtgtgtgtgtatacgatatttggggtaaatacttttcccagcttctttgacttttaattttgcttatactttattggaaatacagaacctttattttattattattattatactttaagttctgggatacatgggcagaacgtgcaggtttgttacataggtataaacgtgccatggtggtttgctgcacccatcaaaccaccatctacattaggtatttctcctaatgctatccctcccatagtccgccacccaccaacaggccctggtgtgtgatgttctgctccctgtgtccatgtgttctcatgagaacctttatattttatgtagtggagtaagttattttatcttttttttttcctgtgtaacttctgttacctcaggcttaggaattccttcctacccagaagttagaaaatattcatctatttttttttaaagtttcatttttaacattaaactcaccaaattagaagtaagatgtggccaggcacagtggctcacacctgtaatctcagtgctttgcgggggctaaggtggaaaaatcacttgaggctaggagttcaagacaagcctgggtaacacagtgagaccccacctctaccaaaaaatttaaaaattaggcaggcatggtagcatgtgtctgtagtcctagctgcttgggaggctgaggtgggaggatcacttcagcccagaagcttgaggctgtagttagctattatcatgctattgcattccagcctaggcaacagagcaagaaccctgtg

SEQ ID NO: 11404 - DNA, 547 bp, Homo sapiens
gtgcttgagtgtagggagtgaaaaatctaggtgtgtgaagctgtttgtgtcagtttgtgtgtgtgactgcaggtgtacatgtgtttgcaagtgtttgagaatgtgtctgtcctttacataccacttctgggcctcctcgcacctccccagtgaatctgtctcctccaagacacctagccttccttcagcaactcagcgtttctacctatattacggactttgtaacctttcaaataagcacagaacccttgctcccggaggagtcaatttagactcacttgcctggtctatcatcaagctcctcagctgaggcccacatggtggtgccaatgaggctggaccaacctgctctgacaaccaggctcccacagatctcaacgaaggcatcctaaagaggcctgcaattgagggtgggctctgagggatttcactctggctgcttcatgactccctgatactcaagtatattttcccaaagaccacggatgctgtgaggataaacactacatctgcaccaataaaaaatccatatattaaaatgttaata

SEQ ID NO: 11405 - DNA, 437 bp, Homo sapiens
gaacttaaaattaaatttgaagcactgtagagatcagttaaagtaaaggcccctgagtcaggcaacctaggcttgctccccagcttccctagttttagggtgaatttggccaaatgtttaacttctccacgtgtcaggctgtgtctgaaaaagaaaatgacaatagtactccatcttagagttttttaagataacttacctggtaccaagtaaatgcagaataaactctaaccactattatttaagtatttttaaagccatctaatagaaggatagaaaattatttgataagaattcaaccttgaggtagagaaaatggttaaaagactatttgaagtagttcatgttaccgaagatactattataaattaaggttgacagcatggatgcagagaaagtggcagactttagagaaaactttacatgccactcatttg

SEQ ID NO: 11406 - DNA, 488 bp, Homo sapiens
agtctggtaaagcccattttcttgaagtctttgttccttcacatgagaacggtgtgcttccaggatatgtcacttattatgttaaactacaatttaaaaccatagaatttgctcattcagcaagtgtttattgagtcctgatgtgccaggtactgggcaaagcaccggtcataaaaaggtgaaagaagtgtaaaacaaatagaaaaaaacataggggaaaattaccatgacattggtctgggcaagaagttccttccttccttccttccttccttccttccttccttccttccttccttccttccttccttccttcttccttccttcctccctccttccctccctgcctctctctctttctttctttctgaaaaggggtttattttcaacagacatttctttttataccgaggtgaaatgtcatcatcataataattttgcaatgttacataccctgttgagaccattaaaaaattaggttcatggta

SEQ ID NO: 11407 - DNA, 344 bp, Homo sapiens
gggttcggatctcgaacctggggccttgaagaggcccgcgcttggggtttttaggcaacagcaggcctccaagcagagtcctggtgtcccggaccgaatcactccccgagagacgggcaaggagatggaccgccagccaggaataatgggaacccttcgcttggcaaacgatagtttccaaacttaaggttgtggatgaaactttttggtgcggctgctgcaggagccccagccccggggtgctgctgacccgaggcaagggagccggcgcactcacgcttagccgctaaggagtctgcggtgtcggcgaaagctccggacatgattttggaaggtcgtaggtt

SEQ ID NO: 11408 - DNA, 438 bp, Homo sapiens
gtctttccagtaggagttgggaaataactttttttcctcttaaactcatgctgcacaattaaagaaaaatgttttttctctgaacctttccttcaaatacttggcagagattactgccagaagaatgagatgggcacagtggctgatgcctggtaatcccatcactttgggaggacacgatggtaagattgcttgagcccaggagttcgagactagcctgggcagcatagggagacccatctctacaatttttttttttaaagccaggcagggtggtatgtgtctgtggtcccagctactcaggaggctgaggtgggaagatcacatgagcctgggaggtcgaggctgtagtgagctgttatcatgccactgtactctatctagcctgggcaacagaggctagagcaactctgtctcaaaaataaaataaaataaaat

SEQ ID NO: 11409 - DNA, 903 bp, Homo sapiens
gcaccagaagaagggacaagcagttctgtatgaaggtggaaaaggctatggaaaaagccagctgttggctgaaataaactttctggcacagaaagaagggcatagctacccttcacaggtgctttggaaacccactttattgtgaggtcctatgccaggaccttctctctaaggacgtgttgctctttcatgtcctacaaaaggaggaagaggaaaacagcaagtgggaaaccctctcagccaatgccatgaaatccataatgtatagtatttctcctgccaactctgaggaaggccaggaactttatgtctgcacagtcaaggatgatgtgaacttggatacagtacttctcctaccctttttgaaagaaatagcagtaagccaactggatcaactgagcccagaggaacagttgctggtcaagtgtgctgcaatcattggtcactccttccatatagatttgctgcagcacctcctgcctggctgggataaaaataagctacttcaggtcttgagagctcttgtggatatacatgtgctctgctggtctgacaagagccaagagcttcctgctgagcccatattaatgccttcctctatcgacatcattgatggaaccaaagagaagaagacaaagttagatggtaggtatgatgaaaggaggtaggtatgatgaaggacgcgtccttcatcatacctaccaatgaatatcttcctattcccagtctaagagtttttccattatattctacaaatccatcatttccctaaagaaacaaacgaaaaaaatccttgcttttggctatagttcataaatgatttaatagatcatcatttcttcattgtaaatgtagtgttttaaccatacaatgtaggtgggtatgggtaggtatgatgaaaga

SEQ ID NO: 11410 - DNA, 1041 bp, Homo sapiens
gcaccagaagaagggacaagcagttctgtatgaaggtggaaaaggctatggaaaaagccagctgttggctgaaataaactttctggcacagaaagaagggcatagctacccttcacaggtgctttggaaacccactttattgtgaggtcctatgccaggaccttctctctaaggacgtgttgctctttcatgtcctacaaaaggaggaagaggaaaacagcaagtgggaaaccctctcagccaatgccatgaaatccataatgtatagtatttctcctgccaactctgaggaaggccaggaactttatgtctgcacagtcaaggatgatgtgaacttggatacagtacttctcctaccctttttgaaagaaatagcagtaagccaactggatcaactgagcccagaggaacagttgctggtcaagtgtgctgcaatcattggtcactccttccatatagatttgctgcagcacctcctgcctggctgggataaaaataagctacttcaggtcttgagagctcttgtggatatacatgtgctctgctggtctgacaagagccaagagcttcctgctgagcccatattaatgccttcctctatcgacatcattgatggaaccaaagagaagaagacaaagttagatggtgggtcagcctctcttctcaggctacaagaagaattatccctaccacaaactgaggtgttggaatttggagtgcctctgctacgggcagctgcttgggagctctggcccaaggaacaacagatagctctgcaccttgaatgtgcctgctttctccaagttttggcctgccgctgtgggagctgccatggaggagactttgtcccctttcatcattttgcagtttgttctactaagaattccaaggggacctctcgattctgtacttacagagatactggctcagtgctaacacaagtgatcacagaaaaattgcagctgccttctccccaagaacagaggaagagttcctagatcaagtgaagaggaagctggctcagaccagccctgagaaaga

SEQ ID NO: 11411 - DNA, 715 bp, Homo sapiens
acggagcccggcgaggcgtgcggcggccgcacaagccgcacggcgtccctggtgagcgggctgctcaacgagctgtacagctgcacagaggaggaggaggcggcgggcgggggccgcggggccgagggccgccggcggcgccgcgacagcctcgacagctccaccgaggcctcgggctccgacgtggtcctgggcggccgcagcggtgccggcgactcccgcgtgctgcaggagctgcaggagcgaccgagccagcggcatcagatgctgtacctgcggcagaaaggtgagggccgggcgcagcagggtcccgggggcttcctggagccgggttgtcctcgccgtctctgcccgcgctccagcgcgcacctgggctgctcggcggagcgctcagatactgtctctttggatctgacggtggtacccaccgtggcacagatttatgtccacacttagttcttaagttctccggagtaattgaatcaagcgtcagttgatggagtgggcagtttccccgctcttccctcctcccatctcccggtgtgttcgcggaggccccaggggagaggcagcccagattctaatttcacctgaacagctgttaggacagggttggaggttctgatacgtatacctgacctacctagagggcgccgccagaatcgaggcgagtcgtagggctgttctttcctttttttttttttgtttttttgtt

SEQ ID NO: 11412 - DNA, 7637 bp, Homo sapiens
  misc_feature (7175)..(7175): n is a, c, g, or t
acggagcccggcgaggcgtgcggcggccgcacaagccgcacggcgtccctggtgagcgggctgctcaacgagctgtacagctgcacagaggaggaggaggcggcgggcgggggccgcggggccgagggccgccggcggcgccgcgacagcctcgacagctccaccgaggcctcgggctccgacgtggtcctgggcggccgcagcggtgccggcgactcccgcgtgctgcaggagctgcaggagcgaccgagccagcggcatcagatgctgtacctgcggcagaaagacgctaatgaactgaagacgatccttcgagagctaaagtacagaattggcatccagtcggccaagttacttcggcatctgaagcagaaagataggcttctgcataaagtgcagaggaactgtgatattgtgactgcctgcttgcaggctgtgtcacagaagagaacatggcagaacagtatgctcaggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatgatgtctccccgaaactttgtatctggactcaccttttcacagtagtataagggttgcagctgaatggctctaaaagagttttatttgtccagtgaaaatgaataggttcagggatgagcaacagcccataaaaaatgggaactggaagttttataataggagttagaacagggctgttttcccagctacttgctaactgacgaagtggattcttgtggcaaaataaatattgtggttttatagtgtgaagttttcccaatttttcattgtgagctgtttaaaaaagactatatctagattgttaactctcgtccatccttctgttctgggggccttcagagtccctgtgacagcacccccaaaccttccagttctctgggtgttactaatactcaagcatgcacataccagcttgctaggacagaaactgtaaaaagaaagtaagtttcttcgttacaaaaaacttcctgattttccttttcatgctttacggaggggattgtgtcgtgtgagatttcccacagtaccagtttcaaatttttttttattcttatgctaaatcataggagaaaaatctagatagcctttctttaactgtctatttctacctgcaaaatgaagaaaacctttcatctgttgaaatttcaatcgataacccagctgaagatcttatgcacaggacacacttggcatatgctttacgcagttgctccggacagcttgctcgcgccactgagcttttcctgaggtttgtgttcgcctctcaaggagagctttgatcctcagtggtacggatgacttgatgggctccatgcggagcctggcctgcatcccccaccacacagctcactcacccaccagctctagactgcagacgcacaaggcctctgctcagaagccagaacacagcacctgtgactctgttacttgaattttgtgctttttgattggagtcctttgttgagtactttgttaattgaacactgcctttctctggagaaggccccagtgctttctagctccctctcactcctgccctttctagctctctctcacccagcgggtcagggatagcacctcttgtctccactatgcagatgggaactctgagccacacagaggtgaagtagcacttcagttactcaaggtcagtactctcggtattccaagtgacttagccacatttccttcagtgcaataggtgggtttaatgctctttgtacacagatgtattggctacatagcgtgtaaaaaccaagactgggaagccattcactaaaatccctcctgactcaaaggacctgtctccagatggtacagagtcccttgatggcattttacaaaaccagctctgacttccttatcctgaacagggagtttattttaaaaatgcttcatgcacctgttatttggctgaacagaaggctcactcctcaatccccttctcctcgccatcattagaggaatagactcagccttcatgtttgtctctggaagacgattggcgatacttgcaggaatattgttgatgcagccaatattaatttgagctaatggattgttaattctgaaacgaaaactgtaactgtagagcaggcttttactatgagaggtactactttttataatagagaatgtggttgtgtgggctttttttgaacagaaaacacaacaatgacctataccgtgagaaaagccattttatcttcttcgtggtatttttacccccaaaggaactgaagatggaaaatatgactaataagttattgcagttttggtcttgaattctgtgccatctgaagttagcatccagcttcttaaaaagcagccacgcctacagcctgttttttgggaaggctgtaggtggagagatgggcttattttgcataccaccctcagggcccagagacccactgcattttccaaagttaagcaaatgacaccattttcttccatcagctaaactttacagataatagtgtttccacctcatatccttttctttgccccttctcaaatgagtcagaatagtcatgttccccttgagggatgtctgacttgaatggagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttggtcttcctgagaaggggatggatgaggtaacacacagtttgggatacgtatctgttgaatgaatgaataagtgaaaggataatagtcctctgaggtaaaaatggccttgtcagaattttgaaaatccaacagattcctattaaagcactctgtgtaccaataacatgcatgcattgtaccaagtaatcacaatgtgaattggtcaatttatgagccttgcctactttagaaaataaagaaacctgcagtagcctctaccacacagcatgtacaaagaccagtatggacttgctatcttccctatgtattggacactgtatgcaaacaccagaagtacttaacaagtagtggtttcttgatttttagatatgtctgtagcctcttagcccttttgccgggaatcaactcattctgatgcctctgcacctcagttcctcttacaaaagcctccagatgatctaaatctagttagcaatgtcagcctgtggactgcagctgtttgggacattgtattcctttgtttgtctcttgttgttctgaaggattgtattgatcacaaagctatatgcataaagattctcattgttgtaactgttctgccattttctgagtgcaagcatggaacactgttgtgacagtcccttctcccttcttccttcttccttcacccccaaccccagaccccccttggtcacatgaaccagggaaacagcccaataagctctatctcccccagtctaatcgctgggttgcagggtggcctgtgacctgcccagcatttgcagactcgctggttcctgaatatgagtaagcacagagtttacctagagagtttacctaaaattaacctttagatctactatttatttttgtcttaataaaatgaacaataaatatagtttagctgcatggcattaaggattctgtatgaatagatgtatagttgctgccatctccccatataaaaactctctttacatcgtttctgagccactttctttgctgtctgcagcatttaaaatatattatttttcctaattagaaaagtcacaggttttagaaaattgggaaaacaaaaagagcataaagaatcatcaatactctgatatagatatagatctttccagtacgtttgtgtatgtgtgtacacgccattatctacaaaaaagttatgttgaacatggtagtttaagctgtctttctggtaaatgctcttatacaatatgatttttagtgactaatattccctaatgtgttcatgccagaattcacataaccagtaccttgtcaaataggaggtttctgattagatagtagtagagacagtatcctgttacatgtatgtacatagcccgaattattttcttaggatatgcgtatagaagtggagttgaagggtcaggaaatatgtccatttttaagatacatatatctccaaattgccattcttaaaggttggagttatacaagtagtgaatgagaatgcctgcttctctacatcctggaagaggcagcagtctctttccttttttttcctttctatgacttctagtgtggaagtgccaacagaagtgttttagaagcagtgataatgaacactcataacacccatacctcattcctgacttctaaaagaagcattaagtaagatgttgaggtttctggtaggtgcctattatttaggttaagaaaattccccttttattctttgcttgctaagagttttcttcatcaacaggtattgaatttcataaaaagaactttaattgtatcttttgagaagggaatagtacttgagacttggtatcctgaactcaaagaaatagccattactaggttttgtcaaagaataccagatattttagagttggaagttatgcagtaaaagcttatgtgcaaatgttcattgaagtattaaatgtactaatggaaacctgaaaacaatataaacatctgggaataggggagatgtttggatgaattatgattcatccccaggatggaaatgtgaaggccggtgagtatttggaccattgaagtgggagttatctgttatccacatcaggcagctcagagtaaagtcagcaagtctacagtcatagagccaccaggatacagtgatggatgggaggcctttgctggacagtggctgaaggcagaactgttggagtggttcttccacaaaggcagccagtgctcacctgaatggggactggtactgtaggtattgggtcagctttcatgccgttccctgctggccatctcccaatgctgaatgtctgactcagttcaggctgctgtaacaaagtaccatagnctgaggtggcttaaacacagacatttctttctcacagttctggaggctgagaagtcaaagatcaaagtgtctgcaaaattggtatctggtgaggaagggccctccttcctggtttgcagatggctaccttcctcactgtgtcctcacacaatggagaaagggagtatgttttggtctcttcctcttctgataagggcactaacctcatcatgagggtcccatcctcctggtgtcatctaaacctaattacctcccaatggccccgccttcaaataccatcacgttgaaggttgcttccttcctggtcgtttgctctggtgagaccaaatgacctgcaaagtgtcacttgattccattctctccatcccttccatcccaggcaatctttatctagctacaccaacctgtgccccaggggcttcaagagttgttgttgttttaacattaaaaaaccagaaagtt

SEQ ID NO: 11413 - DNA, 5448 bp, Homo sapiens
acggagcccggcgaggcgtgcggcggccgcacaagccgcacggcgtccctggtgagcgggctgctcaacgagctgtacagctgcacagaggaggaggaggcggcgggcgggggccgcggggccgagggccgccggcggcgccgcgacagcctcgacagctccaccgaggcctcgggctccgacgtggtcctgggcggccgcagcggtgccggcgactcccgcgtgctgcaggagctgcaggagcgaccgagccagcggcatcagatgctgtacctgcggcagaaagacgctaatgaactgaagacgatccttcgagagctaaagtacagaattggcatccagtcggccaagttacttcggcatctgaagcagaaagataggcttctgcataaagtgcagaggaactgtgatattgtgactgcctgcttgcaggctgtgtcacagaagagaacatggcagaacagtatgctcaggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatgatgtctccccgaaactttgtatctggactcaccttttcacagtagtataagggttgcagctgaatggctctaaaagagttttatttgtccagtgaaaatgaataggttcagggatgagcaacagcccataaaaaatgggaactggaagttttataataggagttagaacagggctgttttcccagctacttgctaactgacgaagtggattcttgtggcaaaataaatattgtggttttatagtgtgaagttttcccaatttttcattgtgagctgtttaaaaaagactatatctagattgttaactctcgtccatccttctgttctgggggccttcagagtccctgtgacagcacccccaaaccttccagttctctgggtgttactaatactcaagcatgcacataccagcttgctaggacagaaactgtaaaaagaaagtaagtttcttcgttacaaaaaacttcctgattttccttttcatgctttacggaggggattgtgtcgtgtgagatttcccacagtaccagtttcaaatttttttttattcttatgctaaatcataggagaaaaatctagatagcctttctttaactgtctatttctacctgcaaaatgaagaaaacctttcatctgttgaaatttcaatcgataacccagctgaagatcttatgcacaggacacacttggcatatgctttacgcagttgctccggacagcttgctcgcgccactgagcttttcctgaggtttgtgttcgcctctcaaggagagctttgatcctcagtggtacggatgacttgatgggctccatgcggagcctggcctgcatcccccaccacacagctcactcacccaccagctctagactgcagacgcacaaggcctctgctcagaagccagaacacagcacctgtgactctgttacttgaattttgtgctttttgattggagtcctttgttgagtactttgttaattgaacactgcctttctctggagaaggccccagtgctttctagctccctctcactcctgccctttctagctctctctcacccagcgggtcagggatagcacctcttgtctccactatgcagatgggaactctgagccacacagaggtgaagtagcacttcagttactcaaggtcagtactctcggtattccaagtgacttagccacatttccttcagtgcaataggtgggtttaatgctctttgtacacagatgtattggctacatagcgtgtaaaaaccaagactgggaagccattcactaaaatccctcctgactcaaaggacctgtctccagatggtacagagtcccttgatggcattttacaaaaccagctctgacttccttatcctgaacagggagtttattttaaaaatgcttcatgcacctgttatttggctgaacagaaggctcactcctcaatccccttctcctcgccatcattagaggaatagactcagccttcatgtttgtctctggaagacgattggcgatacttgcaggaatattgttgatgcagccaatattaatttgagctaatggattgttaattctgaaacgaaaactgtaactgtagagcaggcttttactatgagaggtactactttttataatagagaatgtggttgtgtgggctttttttgaacagaaaacacaacaatgacctataccgtgagaaaagccattttatcttcttcgtggtatttttacccccaaaggaactgaagatggaaaatatgactaataagttattgcagttttggtcttgaattctgtgccatctgaagttagcatccagcttcttaaaaagcagccacgcctacagcctgttttttgggaaggctgtaggtggagagatgggcttattttgcataccaccctcagggcccagagacccactgcattttccaaagttaagcaaatgacaccattttcttccatcagctaaactttacagataatagtgtttccacctcatatccttttctttgccccttctcaaatgagtcagaatagtcatgttccccttgagggatgtctgacttgaatggagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttggtcttcctgagaaggggatggatgaggtaacacacagtttgggatacgtatctgttgaatgaatgaataagtgaaaggataatagtcctctgaggtaaaaatggccttgtcagaattttgaaaatccaacagattcctattaaagcactctgtgtaccaataacatgcatgcattgtaccaagtaatcacaatgtgaattggtcaatttatgagccttgcctactttagaaaataaagaaacctgcagtagcctctaccacacagcatgtacaaagaccagtatggacttgctatcttccctatgtattggacactgtatgcaaacaccagaagtacttaacaagtagtggtttcttgatttttagatatgtctgtagcctcttagcccttttgccgggaatcaactcattctgatgcctctgcacctcagttcctcttacaaaagcctccagatgatctaaatctagttagcaatgtcagcctgtggactgcagctgtttgggacattgtattcctttgtttgtctcttgttgttctgaaggattgtattgatcacaaagctatatgcataaagattctcattgttgta

SEQ ID NO: 11414 - DNA, 7615 bp, Homo sapiens
  misc_feature (7153)..(7153): n is a, c, g, or t
acggagcccggcgaggcgtgcggcggccgcacaagccgcacggcgtccctggtgagcgggctgctcaacgagctgtacagctgcacagaggaggaggaggcggcgggcgggggccgcggggccgagggccgccggcggcgccgcgacagcctcgacagctccaccgaggcctcgggctccgacgtggtcctgggcggccgcagcggtgccggcgactcccgcgtgctgcaggagctgcaggagcgaccgagccagcggcatcagatgctgtacctgcggcagaaagacgctaatgaactgaagacgatccttcgagagctaaagtacagaattggcatccagtcggccaagttacttcggcatctgaagcagaaagataggcttctgcataaagtgcagaggaactgtgatattgtgactgcctgcttgcaggctgtgtcacagaagagaagagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatgatgtctccccgaaactttgtatctggactcaccttttcacagtagtataagggttgcagctgaatggctctaaaagagttttatttgtccagtgaaaatgaataggttcagggatgagcaacagcccataaaaaatgggaactggaagttttataataggagttagaacagggctgttttcccagctacttgctaactgacgaagtggattcttgtggcaaaataaatattgtggttttatagtgtgaagttttcccaatttttcattgtgagctgtttaaaaaagactatatctagattgttaactctcgtccatccttctgttctgggggccttcagagtccctgtgacagcacccccaaaccttccagttctctgggtgttactaatactcaagcatgcacataccagcttgctaggacagaaactgtaaaaagaaagtaagtttcttcgttacaaaaaacttcctgattttccttttcatgctttacggaggggattgtgtcgtgtgagatttcccacagtaccagtttcaaatttttttttattcttatgctaaatcataggagaaaaatctagatagcctttctttaactgtctatttctacctgcaaaatgaagaaaacctttcatctgttgaaatttcaatcgataacccagctgaagatcttatgcacaggacacacttggcatatgctttacgcagttgctccggacagcttgctcgcgccactgagcttttcctgaggtttgtgttcgcctctcaaggagagctttgatcctcagtggtacggatgacttgatgggctccatgcggagcctggcctgcatcccccaccacacagctcactcacccaccagctctagactgcagacgcacaaggcctctgctcagaagccagaacacagcacctgtgactctgttacttgaattttgtgctttttgattggagtcctttgttgagtactttgttaattgaacactgcctttctctggagaaggccccagtgctttctagctccctctcactcctgccctttctagctctctctcacccagcgggtcagggatagcacctcttgtctccactatgcagatgggaactctgagccacacagaggtgaagtagcacttcagttactcaaggtcagtactctcggtattccaagtgacttagccacatttccttcagtgcaataggtgggtttaatgctctttgtacacagatgtattggctacatagcgtgtaaaaaccaagactgggaagccattcactaaaatccctcctgactcaaaggacctgtctccagatggtacagagtcccttgatggcattttacaaaaccagctctgacttccttatcctgaacagggagtttattttaaaaatgcttcatgcacctgttatttggctgaacagaaggctcactcctcaatccccttctcctcgccatcattagaggaatagactcagccttcatgtttgtctctggaagacgattggcgatacttgcaggaatattgttgatgcagccaatattaatttgagctaatggattgttaattctgaaacgaaaactgtaactgtagagcaggcttttactatgagaggtactactttttataatagagaatgtggttgtgtgggctttttttgaacagaaaacacaacaatgacctataccgtgagaaaagccattttatcttcttcgtggtatttttacccccaaaggaactgaagatggaaaatatgactaataagttattgcagttttggtcttgaattctgtgccatctgaagttagcatccagcttcttaaaaagcagccacgcctacagcctgttttttgggaaggctgtaggtggagagatgggcttattttgcataccaccctcagggcccagagacccactgcattttccaaagttaagcaaatgacaccattttcttccatcagctaaactttacagataatagtgtttccacctcatatccttttctttgccccttctcaaatgagtcagaatagtcatgttccccttgagggatgtctgacttgaatggagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttggtcttcctgagaaggggatggatgaggtaacacacagtttgggatacgtatctgttgaatgaatgaataagtgaaaggataatagtcctctgaggtaaaaatggccttgtcagaattttgaaaatccaacagattcctattaaagcactctgtgtaccaataacatgcatgcattgtaccaagtaatcacaatgtgaattggtcaatttatgagccttgcctactttagaaaataaagaaacctgcagtagcctctaccacacagcatgtacaaagaccagtatggacttgctatcttccctatgtattggacactgtatgcaaacaccagaagtacttaacaagtagtggtttcttgatttttagatatgtctgtagcctcttagcccttttgccgggaatcaactcattctgatgcctctgcacctcagttcctcttacaaaagcctccagatgatctaaatctagttagcaatgtcagcctgtggactgcagctgtttgggacattgtattcctttgtttgtctcttgttgttctgaaggattgtattgatcacaaagctatatgcataaagattctcattgttgtaactgttctgccattttctgagtgcaagcatggaacactgttgtgacagtcccttctcccttcttccttcttccttcacccccaaccccagaccccccttggtcacatgaaccagggaaacagcccaataagctctatctcccccagtctaatcgctgggttgcagggtggcctgtgacctgcccagcatttgcagactcgctggttcctgaatatgagtaagcacagagtttacctagagagtttacctaaaattaacctttagatctactatttatttttgtcttaataaaatgaacaataaatatagtttagctgcatggcattaaggattctgtatgaatagatgtatagttgctgccatctccccatataaaaactctctttacatcgtttctgagccactttctttgctgtctgcagcatttaaaatatattatttttcctaattagaaaagtcacaggttttagaaaattgggaaaacaaaaagagcataaagaatcatcaatactctgatatagatatagatctttccagtacgtttgtgtatgtgtgtacacgccattatctacaaaaaagttatgttgaacatggtagtttaagctgtctttctggtaaatgctcttatacaatatgatttttagtgactaatattccctaatgtgttcatgccagaattcacataaccagtaccttgtcaaataggaggtttctgattagatagtagtagagacagtatcctgttacatgtatgtacatagcccgaattattttcttaggatatgcgtatagaagtggagttgaagggtcaggaaatatgtccatttttaagatacatatatctccaaattgccattcttaaaggttggagttatacaagtagtgaatgagaatgcctgcttctctacatcctggaagaggcagcagtctctttccttttttttcctttctatgacttctagtgtggaagtgccaacagaagtgttttagaagcagtgataatgaacactcataacacccatacctcattcctgacttctaaaagaagcattaagtaagatgttgaggtttctggtaggtgcctattatttaggttaagaaaattccccttttattctttgcttgctaagagttttcttcatcaacaggtattgaatttcataaaaagaactttaattgtatcttttgagaagggaatagtacttgagacttggtatcctgaactcaaagaaatagccattactaggttttgtcaaagaataccagatattttagagttggaagttatgcagtaaaagcttatgtgcaaatgttcattgaagtattaaatgtactaatggaaacctgaaaacaatataaacatctgggaataggggagatgtttggatgaattatgattcatccccaggatggaaatgtgaaggccggtgagtatttggaccattgaagtgggagttatctgttatccacatcaggcagctcagagtaaagtcagcaagtctacagtcatagagccaccaggatacagtgatggatgggaggcctttgctggacagtggctgaaggcagaactgttggagtggttcttccacaaaggcagccagtgctcacctgaatggggactggtactgtaggtattgggtcagctttcatgccgttccctgctggccatctcccaatgctgaatgtctgactcagttcaggctgctgtaacaaagtaccatagnctgaggtggcttaaacacagacatttctttctcacagttctggaggctgagaagtcaaagatcaaagtgtctgcaaaattggtatctggtgaggaagggccctccttcctggtttgcagatggctaccttcctcactgtgtcctcacacaatggagaaagggagtatgttttggtctcttcctcttctgataagggcactaacctcatcatgagggtcccatcctcctggtgtcatctaaacctaattacctcccaatggccccgccttcaaataccatcacgttgaaggttgcttccttcctggtcgtttgctctggtgagaccaaatgacctgcaaagtgtcacttgattccattctctccatcccttccatcccaggcaatctttatctagctacaccaacctgtgccccaggggcttcaagagttgttgttgttttaacattaaaaaaccagaaagtt

SEQ ID NO: 11415 - DNA, 310 bp, Homo sapiens
tggactatctaaatattattcaaaagctttcctaactaaaatggaagttcctttcctgtttccaatgggagcagctttaaaaatgcagaaagcctgtgaaaatgtcagaacacgacaaatcataaactgataacgtgccatttactgtacctcacttattcctaaataaaattgtaataagaaaatatatattttaaaatatatattttaaaactcacagtttttgcatcaaaggtcacaatcaacagagtgaaagcaaccaatggaatagggggataccatattcgcacattacatatctgaaaagggg

SEQ ID NO: 11416 - DNA, 473 bp, Homo sapiens
cacacccagtcctgagggaggcagcagacagacatggatggagtgctggtgctcggtagagttgaagaggggatgggagccagatgtggctacagcactttcatctgtggggcccggcctcagacccacaacagtcccagccccaagaaagtgctgcatgcagccaggctcgatggctcacgcctgtaattctagtactttggaggccgaggcgggcagattgcctgagctcaggagtttgagaccagcctgggcaacacggtgaaaccccatctctactaaagtacaaaaaattagccaggcgtggcgcatgcgcctgtagtcccagctactcgggaggctgaggcaggagaatcgcttgaacccgggaggcagagtttgcagtgagctgagatcacgccactgcactccaacctggtgacagagcaagactccatttcaaaaaaaaaaaaaaaaaaaagagtgcagcatgc

SEQ ID NO: 11417 - DNA, 347 bp, Homo sapiens
ttatttaaaaaaatatgcctttgaagaactgtacaatgtgatgtacctattgtctgtattattttgaatgttcatgagagcttcttaaagcattttaaggttgaaaatttcatagactttaaaagatttataacatatattttatttactgctatattagatgggtttattaccagtaataaagaggtatatctaatatttactctgtggttctacagctgtttattctgttgcgattgccagaattcttgtgtattgataagcgctctttctggacagttgtctgaattactgcaccctttcccactgaaaacacccctcccagttccagtgcttcatggatgaac

SEQ ID NO: 11418 - DNA, 546 bp, Homo sapiens
ttggtgggtggggggatggagtttcactcttgttgcccaggttggagtgcaatggcacaatctcagctcactacaacctccgccttccaggttcaagcaattctcctacctcagcctcccaagtagctgggattacaggcatgcaccaccatgcctggctaatattttttttgtatttttagtagagatggggtttcaccatgttggccaggctggtctcgaacttctgacctcaggtgacccacccaccttggcctcccaaagtgctgggattacaagcgtgagccaccatggccggcctactttattttcttgtatagacagagaaattgaaatttagagagattaaataatttgaccaagatcatgaaactagaaaatattgaggaggccagaattaggtactctaaccccaaaatctacgttcttgaccccgtgctaagctttttcctcaaaccccgttcagttcatgtccttgccaaccccttacttgtgtcggcccctaatctacatctccctttcctcagctgtcttggccagttcttc

SEQ ID NO: 11419 - DNA, 421 bp, Homo sapiens
ccttttgaatatgaggaattcctagagcttgacaggctatactaaaaaagagctgcaagaattatatacagtattctacagtttgcatttcagtggttccctcttttgaggatgttacgtgccagtaaaattacagaaaaaaaaaaagcagtttgtcaatttttcttcaggtaaaggcattaaaaacatagccaccatttattttcactataatttcataaaaataaagcacctttataataacaaaagaagataaagaacgatcatagaataaaagacaatacttcctttcaaaaggagggttggtgctgggcacgttggctcccacccaaaatcccagcactttgggaggccaaggtgggaggatcgtttaaaagccaggtgtttgagactagcctaggcaacacagcgagatcgcgtc

SEQ ID NO: 11420 - DNA, 484 bp, Homo sapiens
gctgacctaccatggctgttttaacttctcctctgagtgcatcttccctgttttacattatgcaaaccactcccaaattttttaaaccagtttcccatggcttaagcaatgatcccagtaatatccctccaagcttcaagggggattcttacgcaggtttctctgccaagagcagcttctaccatgcacctttccaaataatagtcatgtactggctgggagcagtggctcacgcctgtaatcccagtaatttagaagaccaaggcaggcagatcacctgaggttaggagttcgagaccagcctggccaacatggtgaaaccctgtctctactaaaaatacaaaagttagccaagcacagtggtgggcgcctctaatcccagctactcaggaggctaaggcaggagaatcgcttgaacctaggcggtggaggttgtagtgagccactgcactccagcctgggtaacagagcaagactcagtctc

SEQ ID NO: 11421 - DNA, 318 bp, Homo sapiens
cccagagcttcctggcataagcttcccagggaccatttaacaaggatggcctcatctttccgggagcctggcagagcttccgtggaattcctggagtcaggtgtcaatgtacccatttgaggatgaggaaactgaggtttggatgaagaagtcaccccgtggccccacagcgaggaagcagcagagccagatgcaaatgcagcctctggactccccgtctggtgctcccctcggcccctgccctcctctcctgtcccacactccagccagcaccgagcacccagcctggcctgaacatgggtgattccaggggccctg

SEQ ID NO: 11422 - DNA, 344 bp, Homo sapiens
gaatattaagaagttactctgtgccaggaaggaactggagactaagatgcataggatacaccccctgcagagaaagacagcaaaatctcaagccaacatcagtcatcaagtgccacaagtgccattcaatcatttattcattcacattcacagcagtaaacagaacaaagatccaccatcacagagcttatattctagaagggaagacaggtacattactaaatatataatgttagatcagtactacaaagaaaaagtaagctggtgtaaaggctaaagaaggggtagttctattcagaaaaatgagaaggggaggaatatctcagggtggtctaagacagcct

SEQ ID NO: 11423 - DNA, 503 bp, Homo sapiens
gtcccagtttcactctgtcatccaaactggagtgcagtggtgcagtcttggctcactgcagcctcaacctcccaggttcaagtgatcctcccaccttagcctcccaagtatctgggactacagcaatatggagaaggcatcaagaatgtacttcattcacccgccaacagtataaagaactagaagctctgtttagccagaccatgttcccagacagaaatcttcaggagaaactagctttgaaactcaacctaccagagtcaacagtaaagaacccagtgtcatggtaaattggagaggatgtgagatgataacctggctgttttcactcaggagaagcctggaatgccttctccaagaacagaccacaatctcccctcttcccccactcccaggtttggtttaggaaccggcgattcaaattgaagcagcagcagcagcagcagcagcaatcagcaaagcaaccaaaccagataccttccatccaagaagaatgtgcccac

SEQ ID NO: 11424 - DNA, 197 bp, Homo sapiens
gacccactgagggagcctgctgacaccagggagtggcgatgaccctttcattatctgtaaaccaagctatccacagcatcaggagtcccagctgaattattcactgaatgcactttggccagggcaggagggatctttttaaattcagcttactctctctcccagatctgtggagccagcagagtggtcccagcctt

SEQ ID NO: 11425 - DNA, 478 bp, Homo sapiens
gaggggtcttctgttttccctagaatagtttacagtgaaaatgtatttaggttgtatatctataattaaatatagaattttgacagaatttatctcccctaacagaattttaaatagcgaagtttttactaacataaacatgcatttataaagaattcattccatggaggagaatgagagatgttaataagtacaaacaaattaattagaaagaatgaataagacctagtatttgaaagcacaacgggacgactataggcaataataattgtacatttaaaaataactaaaagggtgtaattggatttttgtaacataagggataagtgcctagggggatggatacctcattttctgtgacatgattattatgcattgcatgcctgtgtcaagacatctcatgtaccccataaatatatatgtctactatgtacccacaaaattttttaaaaaagaactcattctatctctgtgttat

SEQ ID NO: 11426 - DNA, 515 bp, Homo sapiens
gcttccagctcatatggtggattcaaagatttcctgactggcaattggttgaaagtttatctaaacacaggaatcaacagaagggagtttctgggttatgataagaggttgtagaggccgaggttcttattatgtaggtgaagcctccagtagcaggcttcagagagaatagactgtaaatgtttcttatcagacttaaaaaggtgccagactcttaattctctcctggatcaggaaaaagacctggaaagggaacagcattctttacagaatgtagattttccccacaggagacagctttgcagggccatttcaaaatatgtcaaagaaatatattttggggtaaaatactttgatttattttagggcctgctaactgtcatgttggtatcttattgcaaaaatggtctgttttgtcagcctaagggttctgttctaatgttaatgctggtcagctgtgcctgagtttcaaggggaggaatatataatgagacacctctgaccacccattccta

SEQ ID NO: 11427 - DNA, 305 bp, Homo sapiens
ttttttaattttctttttaattctcagcaaggcaagttacttctatggagggtgcacccttacagatggagcaatggtgagcgcacacttggacaagggaggggaaggggttcttatccgtgacgcacgtggcccctgctgctgtgtcgttcccctattggctagggctaggccgcacgggctaaactaattccgattgttcttagcctagtcttaaataagaggaaacaaataagtgaacaaatgtcattaaagcaactagttgattatttggggagaaagtatagttagaacccacatccgtg

SEQ ID NO: 11428 - DNA, 457 bp, Homo sapiens
gacctgatgggtgtctgggctgaggtagggaaaagtgccgagtcgcatggtgactcaaggtcaggagctggaatggggcccagagctctcaagcctctgctcacccgcttgggactggcccttggctccaggccagctccctgaatagttcccccaacccccacccttcccctccaggatttcagcttcataggccaatctgcttccttgttcagccactgcctccactgccctcccctcccctccctctgccaaggctacatggaagccctcccccaaactccctccaaggactcagcactggggcccagtgcagtcacccattagagctctccaaggccaggccagcttctgggcagactggccccccttcccagtgttgcccacattcacactctgacagaactcctcccctccttatgcaaaaggaaggaggctttgccagcgctaccttcct

SEQ ID NO: 11429 - DNA, 478 bp, Homo sapiens
attaatctaagcttctgctgtgtatggacctgtggctacattacaaaattcagttgtgaagctataaaatcaattagtctagacctcaaatcttatttcctatgaaaagcctcaaacttgtagctgtatgaacaagtgtttttggaattttttttttttgctagaatggagagaacacactggagatcacaaatgcatttattctttttcaccaactgtttcattggccttaaaaaatactaggctaaacttaagtggtaaagatctgaaataaaaagatgcatctttatgtctgaacagcaatttttcataggtctctaataacttgcatttccttatctatggataaggagatctgaaattgatctacattttctttagtaatgttttctctgtttattgaggacagatatcttcatctccttcatgcattatccttagtaacagatgtcagtaggatccagagccattttggaac

SEQ ID NO: 11430 - DNA, 637 bp, Homo sapiens
gctgggattacaggcatgagccatcacccccagcctgatttacacatattttctactgctctataggttatcttttcatttcctctgtggtaagaagcataaaagttttaaatttttatgaagtccaatttttttgtattgttttgtttgtttctcaagtttttggtattatatgtaagaaacttgccaaattcaagctcatttacctctgttttcttctgagagttttatagctttagtttttagttattttatcgattttgagttttttttgtatatgttttgaggttaagggtccaacttcattcttttgcatgtggctatcctgttgtctcaacactatttgtagaatatactgttctctttctcattgaattgctctggaactcttgtcaaaaatcaattgaccatcagacacataggtttatttcaggactcttaattctattccattgatgtctattcttacgcgagtaccacattgtctaaattattgttgcattgtagtaagttctgaaatcaagatgcatgagcctccaactttgttcctgtttttcaagattgttttggttattctgagtctcttgcatttccatatgaattttaggaccagtctgtcaatgtttgcaaaaaaaaa

SEQ ID NO: 11431 - DNA, 433 bp, Homo sapiens
gcccggaatccccgggatgaccactactactaaatccgcggccgtttggaccgtttttgagttttttttgtatatgttttgaggttaagggtccaacttcattcttttgcatgtggctatcctgttgtctcaacactatttgtagaatatactgttctctttctcattgaattgctctggaactcttgtcaaaaatcaattgaccatcagacacataggtttatttcaggactcttaattctattccattgatgtctattcttacgcgagtaccacattgtctaaattattgttgcattgtagtaagttctgaaatcaagatgcatgagcctccaactttgttcctgtttttcaagattgttttggttattctgagtctcttgcatttccatatgaattttaggaccagtctgtcaatgtttgcaaaaaaaaa

SEQ ID NO: 11432 - DNA, 309 bp, Homo sapiens
caaaccaattaaaaatggaaaggtctgagatgcacagagtgaaactccatctttgtcttgtattataacctttaccaggattatttctctactactgttcagcaatgaatgcctttgctcacttcctactaacagctgtagcatagaaaaaaaaaaagggcaggtcaagtactcaagaagccatgttaacttcccaaatagttatgcaatcagctttaatgaaacagtggtagattacaccaatgtgctaattataggactttgtcatagcataagatgcaacgaaacaacccatgccttggcttggaa

SEQ ID NO: 11433 - DNA, 438 bp, Homo sapiens
cttttgttctcaaccgtcttcatgctgaaaataacttctcaataccagcttaatgacactttaaaatcctttgaataataaaaacaagtttaagattgaatgtaaaagtctcctttgcaaacaaaacagaagtaaaaatttaaactgcaaaatttcaacaacgctgggattcccaaagagagtattaacaaaataaggcattaagcagagaaccaagagtgatgtcaatattcttattaacacatcctaaagtcagaatagtcttttttccatttaaaaacaaaacaatagttaaacaccatctgtaaaagtacagccagtcacttaaactaaatgtattatctgtaaattcacacaaaaagaaaacagtaattccagtcaaactgaaccacctgacttctcccatagtggcctttcttctcccacctccaagtcctc

SEQ ID NO: 11434 - DNA, 485 bp, Homo sapiens
agcgggtgcgctgcgcctgcctccgggaggagccgcatccacacaccctgcgctgccctgtcctgcgcgagtggagctctgaagaagctctgagcggagttgtgttcttccccaggtaaccgatttcccccttctgccgtggcttcgctgcgtccgcattggggcacgggcggctttggcatgattgtttgccagcccctggaaagggattaccgctctcagggagggcgagtcagcgtgtactggagttggtaagaggggaagaaatctgcatttctgtatccttgttagggagggtgagcatcatgctgtccttgtctaaaacatgttcttttttaaaaatctgtatcttacgtattattagggattccttccaaaacaggatttaccgttttggaaaattctactgtgcaggtgtttctgttaatgtggaagtttaatggatttaggaaaagagtaagaagatgtggtctaaagtgagaaaa

SEQ ID NO: 11435 - DNA, 4156 bp, Homo sapiens
agcgggtgcgctgcgcctgcctccgggaggagccgcatccacacaccctgcgctgccctgtcctgcgcgagtggagctctgaagaagctctgagcggagttgtgttcttccccaggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagccaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggccttggcccgcacatggaagtgtgccttcatggagacctcagccaagctcaaccataacgtgaaggagcttttccaggagctgctcaacctggagaagcgcaggaccgtgagtctccagatcgacgggaaaaagagcaagcagcagaaaaggaaagagaagctcaaaggcaagtgcgtgatcatgtgaaggcccttcctgcgggaggagcagctgtgtgtccccggcacctcactcccccaaaatgacacccaccgtcgtcagggtagcatgtataatgcccacgtgttaaacattgcatttaatcgagatgcgtcctattgtccttaagagggcgtttcacaccaccaacagtaagccacccactctggagtcacagaatctgccaggcggttcaagtgaaaaccaacacactcagcatccctgggaactgagaggtgccagcaattgctgaaggtggcgatgaacacccgaaggtgggagggaggactggtacccacaaagcaacatgtaccgagaggactaaatgtcatctacgtgcatgtgagagcgtgttaacctagagttacctgcaccaaccccagacagaagccaatcacatctttgggggaggggaggggcaggaagaggtgagaagatcagatggtccaaagtggaccacacttggtccattttacacttttttaaaggggattaaaaaacacagcctctcccccaaagggtgtccgttcttaattcccacctggcctgttaggagccttgctaccctgaggggatgtgttcaccttacctagacctagttaggaagtatcattttaagctattagagtatttatcttcatgtgcagggataagtgcactaacagtgtgctgctctgtcggaagttcttcagtttttaagtgaggatatcgtgacagtattaaaacatcgcaataatgttcctgtgtgttatacatcgagggttttagaaatgtgattttcttcttttgacctgtgaggagtataacttctttcagccctcagattttaaatacaagcaaataaactcactatttttagacgtttttttcctccaaggtggttttcttctcttaaataactcgatctgtacccagctgggtagcagccagcaaaggccatcagacaaccagaagcacatccatttttgtagtgtcacaaacatgtatatgccacactttgcaccttaatgaaatactttgaaacagaagttattcactgtgtttttgatgatctatctgtattggaaatatgttcctggaaaatgcatttaaataatagtaaattctcttgcatgttccattatacgtgtcttctaagagctgttcaatacagtattcactctagaaacaattatctttttctcttaatgattttgtgtgcatctttaatctttcaagccaaattacagctatttcaggtttcctgtgttagcttggggataggatggtggctggagacaggcaggcttctctgccctgggaagagcccactcagcttaattgctctgccatcgtagagcctggttggacttggcttcctgaaaactcccactgatagtgcctgttagatctcctgtttgtttcagttggcagaacatttactggccccaactgtggcatcatcctctcagcagtcttcctgtcacccgcctggcaggcagaaggagctgcagtcccacgtgggcctgcctgggggggtgggggctgcatggctgttgggtggcagtgtcagcacagggagggcttaagttggggatgtttgaccaggccacctcctgcaactgctgtttctcctgtccctcctatgcagggcttgcagcagcagcagtgtggccatctccatcccccaaagcacacttgctctctcaatatgtcctagttttcttcagccttttctggttcagttcccttgtcctgatctcatcctctctggtctcccaataactcacccttgggatgtgtttagagcgtgggaggtgcctttgagaactgcttgactccatgatctcctagaacaaaaccgccctgactttacagggggaacactcatgctgagctgagaaagcagagaagtggcgtgggagccagctgggggtgaagagcatttgggccagtcccgtggcccccttcagattcctcaagcaggattgttctgttctaaaaagctgttgcacagcattcgcaatgagatctttagttggcggattttctggaacatttgtttttcaacttgtcccgacattttttttctgtttctattctgagagagagatgatcaagttttaatttgggtataggttaaatggaagaagaaacagaacttcatggccaaagtagacctatagattttgattgggttctttgttaacagtagaatgcgatctttgccactgactgtactattaataaggttttaatgtgagatattcctgcaaaccatcccatttctactgattgtaagtcagaatttcttttatccctttcaaatcagtttctacatgtttaagtgttcagggcttcatcagcatgagaagtttgtaattactgaaagtctgatttcattcaggacacatttttttccttcatattttttctgtgaatttataggctaggaaggctattgaagcctcaattatgggtcttcattttgagatcgttttctatgagctgaactgaggatatcaatggttatctcaaaatcgtcttttaggagatccccaattgactcagagtttgaggagttagtatcacagaattagatttttttaaagcatttgtacgtttccattcccaaatatgtagctgtggttcttgaaaacacatcctacattgcatatgggcatagcagtttttgacccaggcagaataagttaatatttaattaaatattgctttgaagatggcgctctgggcatgagcatggggctccatgacttcccttctatccccatgagcccctcctccatccagcgacaagccatgggcatgcatacaatgcagcaagaccaacacaagagcaatattgaattgttcattctatctaaaattacatgtatataaaatatataatttatcttcctgcatttttgaagtataaagtcataaattgtacatatctgtaagctagtatatttgtttcactgtttgtaatatttaagaaatgctcattctttgtagaacaaaaatgtattaaatattttaaaaattgctctgtgatacttaatttttttccccaaaatttgtaatgtgttgcttctacataagttctctggaaatatctacaactaataggacacatgtaaatccttgaagacacatcctggaattcataccccacaaggacagtgtgtatacaaagtatttgcagagcatgacttttatatgtgtgggatatcaatgtgtatatttatatttaaagtgtatttattgttacaagtctattctctattatattttatttactctgcggttataaaaatcacccttgcatacaagtttctagttgccagtgatgttctggaaataatgggagatattacaataaagctacagttatgacaccctggctggaag

SEQ ID NO: 11436 - DNA, 1932 bp, Homo sapiens
agcgggtgcgctgcgcctgcctccgggaggagccgcatccacacaccctgcgctgccctgtcctgcgcgagtggagctctgaagaagctctgagcggagttgtgttcttccccaggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagccaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggccttggcccgcacatggaagtgtgccttcatggagacctcagccaagctcaaccataacgtgaaggagcttttccaggagctgctcaacctggagaagcgcaggaccgtgagtctccagatcgacgggaaaaagagcaagcagcagaaaaggaaagagaagctcaaaggcaagtgcgtgatcatgtgaaggcccttcctgcgggaggagcagctgtgtgtccccggcacctcactcccccaaaatgacacccaccgtcgtcagggtagcatgtataatgcccacgtgttaaacattgcatttaatcgagatgcgtcctattgtccttaagagggcgtttcacaccaccaacagtaagccacccactctggagtcacagaatctgccaggcggttcaagtgaaaaccaacacactcagcatccctgggaactgagaggtgccagcaattgctgaaggtggcgatgaacacccgaaggtgggagggaggactggtacccacaaagcaacatgtaccgagaggactaaatgtcatctacgtgcatgtgagagcgtgttaacctagagttacctgcaccaaccccagacagaagccaatcacatctttgggggaggggaggggcaggaagaggtgagaagatcagatggtccaaagtggaccacacttggtccattttacacttttttaaaggggattaaaaaacacagcctctcccccaaagggtgtccgttcttaattcccacctggcctgttaggagccttgctaccctgaggggatgtgttcaccttacctagacctagttaggaagtatcattttaagctattagagtatttatcttcatgtgcagggataagtgcactaacagtgtgctgctctgtcggaagttcttcagtttttaagtgaggatatcgtgacagtattaaaacatcgcaataatgttcctgtgtgttatacatcgagggttttagaaatgtgattttcttcttttgacctgtgaggagtataacttctttcagccctcagattttaaatacaagcaaataaactcactatttttagacgtttttttcctccaaggtggttttcttctcttaaataactcgatctgtacccagctgggtagcagccagcaaaggccatcagacaaccagaagcacatccatttttgtagtgtcacaaacatgtatatgccacactttgcaccttaatgaaatactttgaaacagaagttattcactgtgtttttgatgatctatctgtattggaaatatgttcctggaaaatgcatttaaataatagtaaattctcttgcatgttccattatacgtgtcttctaagagctgttcaatacagtattcactctagaaac

SEQ ID NO: 11437 - DNA, 640 bp, Homo sapiens
gccctgcagtcttgactgagcttctaatggttgatcagacccttgaatgttgagctctttccatactagacttgaatattctcctgcccatttgatttgttaattaggattcattggctgtttctctgctctcctcttttctctctgttcctgctggttcaagtttaacctccattttctttctcctctgggaagtttcccttatgcctcttgaacagggtcaagagcacttaggagctcagatttacactgtatatcatgagaaaagcattgaaagtttcaaagcaggagagtgacataattagctttatgttttaaagcggatttttgactttagattctggcaatacagtggtcctgtggtctaagacatctgactaaccttcctgctagcaacaattaaaaatgctgagtgcaataaaaaactagcccttaaatggaatgaatgagtcgactacttggtaaggatgctcagaggctaaaactgaatcaaagcaggaactcttagaagtaagcagtgtgttggctaggcgcagtggctcagcctgtaatcccaacactttgggaagccaaggcaggtggatcacttgagctcaggagtttgagacctgccggggcaacatggcaagaccccgtctct

SEQ ID NO: 11438 - DNA, 2819 bp, Homo sapiens
ccagggggacagcaatccacccagggaccccggagtggagatgacagtgttccggaaagtcagttccacacccccggtgcgctgcagctcccagcactctgtgtttggcttcaaccaggtctcggagctgctgccccgaatggaggactctgggccccttagagacatcaaggagctggtgcgggagcagggcagcaacaatgtgatcgtgacttctgccgaccgagagatgctgaagctcagctcgcaggagaaactgattggagaccttccccagacgcctccaggggctgtcccagacccctctcttgccagtacagactcttcagagccttctcccctggctggagatggagcgccctggagtgggagcagcatggctgacactcccatgagccccctgctgaaggggagcctcagccaggagctgagcaagagcttcctgaccctgacccggcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggagcggccgaggagactggcaggcgggaccgctcaagcagtgtgaggcggacccaggccattcggagacgccacaatgcaggcagcaaccccacccctccagcctctgtcatgggctcgccgcccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgcagtgcactatttctacgatgagagcggtgtgcggcgttcctacacctttggcctggctggaggcggctacgagaaccctgtagggcagcaaggggagcagacagctaatggagcctgggaccgacactcgcattcctccagcttccactcggctgatgtccctgaggctacaggcggcctgaacctgctgcagccgaggcctgtggttctgcagggcatgcaggtgcgccgggtgcccctggagatcccggaggagcagacactgatggaagaagcgccaccccgggcccagcatagttacaagtactggcttctccctggccgctggacctctgtgcgctatgagcggcttgccctgctggctctgctggaccggacgcggggagtgctggagaacatcttcggcgtgggcctgagcagccttgtggccttcctgggctacctgctgctgctcaagggcttcttcactgacatctgggtcttccagttctgcctggtcatcgcctcctgccagtactccttgctgaagagcgtgcagcctgatgcggcgtcccccatgcacggccacaactgggtgatcgcgtacagccgtcctgtctacttctgcatctgctgtctgctcatctggctgctggacgccctgggctcagctcagcccttcccacctgtctccctctacggcctcacgctcttctctgcctccttcttcttctgtgcccgagacgtggccactgtgttcaccctgtgcttccccttcgtcttcctcctgggcctcctgccccaggtcaacacctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatc

SEQ ID NO: 11439 - DNA, 378 bp, Homo sapiens
cgtcgcaaagttataggtgttcacatcttcagaggacaagggtctggcatgggcacagtcccagagctgggcctttagggcaagatccatcttccccactgccccactggaaggtgaggcaagacgggcacgccctgactaggctgtccctgcaggacgcggggagtgctggagaacatcttcggcgtgggcctgagcagccttgtggccttcctgggctacctgctgctgctcaagggcttcttcactgacatctgggtcttccagttctgcctggtcatcgcctcctgccagtactccttgctgaaggtcaggccgggctctctgtgtttccttccccacccgacgattccgcaccaccacgacgattccggtccg

SEQ ID NO: 11440 - DNA, 2587 bp, Homo sapiens
ccagggggacagcaatccacccagggaccccggagtggagatgacagtgttccggaaagtcagttccacacccccggtgcgctgcagctcccagcactctgtgtttggcttcaaccaggtctcggagctgctgccccgaatggaggactctgggccccttagagacatcaaggagctggtgcgggagcagggcagcaacaatgtgatcgtgacttctgccgaccgagagatgctgaagctcagctcgcaggagaaactgattggagaccttccccagacgcctccaggggctgtcccagacccctctcttgccagtacagactcttcagagccttctcccctggctggagatggagcgccctggagtgggagcagcatggctgacactcccatgagccccctgctgaaggggagcctcagccaggagctgagcaagagcttcctgaccctgacccggcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggagcggccgaggagactggcaggcgggaccgctcaagcagtgtgaggcggacccaggccattcggagacgccacaatgcaggcagcaaccccacccctccagcctctgtcatgggctcgccgcccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgcagtgcactatttctacgatgagagcggtgtgcggcgttcctacacctttggcctggctggaggcggctacgagaaccctgtagggcagcaaggggagcagacagctaatggagcctgggaccgacactcgcattcctccagcttccactcggctgatgtccctgaggctacaggcggcctgaacctgctgcagccgaggcctgtggttctgcagggcatgcaggtgcgccgggtgcccctggagatcccggaggtgaggagcagccggggaagggccgtgccagtggggcgtgacggggcgggcagatcactgagtccggcctgcatagagagcttgcccaggtgccccaggagggacgggcagtgctgagtgagcgctccaggggccctactgtgtctgtcctgatctttgatgttggcagagactctgggtctgaatggctggagaagtcatttatttgcttactacgaattcctttggagtacattcctaactctggaggggcccacagtgaacaggggccatgggtgttaatgatgatacttgcggaagtggcagtgttctgttagcaagcagggaccctgtgatgactgtgctgccctgcatacactgtgcacgtgtggctgctggggtgctctctgttaacacttcctgtctcagtatactcattaccagcgctctgtcactcttaagaatatcacagtttggacagtaaatttgtatacttaatctattaacaccagaagcgctaaaaatgcgtgaaacgccatcttagagcttaaagaatgatcataaaagggtacccggcacctgaccctcaaggccacagataggttgggcagcccccagaagctcccacctgcccgcttctggttcatttcttccttgtaaccatgtggggtggaagcgtggccggcccgc

SEQ ID NO: 11441 - DNA, 2496 bp, Homo sapiens
ccagggggacagcaatccacccagggaccccggagtggagatgacagtgttccggaaagtcagttccacacccccggtgcgctgcagctcccagcactctgtgtttggcttcaaccaggtctcggagctgctgccccgaatggaggactctgggccccttagagacatcaaggagctggtgcgggagcagggcagcaacaatgtgatcgtgacttctgccgaccgagagatgctgaagctcagctcgcaggagaaactgattggagaccttccccagacgcctccaggggctgtcccagacccctctcttgccagtacagactcttcagagccttctcccctggctggagatggagcgccctggagtgggagcagcatggctgacactcccatgagccccctgctgaaggggagcctcagccaggagctgagcaagagcttcctgaccctgacccggcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggagcggccgaggagactggcaggcgggaccgctcaagcagtgtgaggcggacccaggccattcggagacgccacaatgcaggcagcaaccccacccctccagcctctgtcatgggctcgccgcccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgcagtgcactatttctacgatgagagcgggaccgacactcgcattcctccagcttccactcggctgatgtccctgaggctacaggcggcctgaacctgctgcagccgaggcctgtggttctgcagggcatgcaggtgcgccgggtgcccctggagatcccggaggtgaggagcagccggggaagggccgtgccagtggggcgtgacggggcgggcagatcactgagtccggcctgcatagagagcttgcccaggtgccccaggagggacgggcagtgctgagtgagcgctccaggggccctactgtgtctgtcctgatctttgatgttggcagagactctgggtctgaatggctggagaagtcatttatttgcttactacgaattcctttggagtacattcctaactctggaggggcccacagtgaacaggggccatgggtgttaatgatgatacttgcggaagtggcagtgttctgttagcaagcagggaccctgtgatgactgtgctgccctgcatacactgtgcacgtgtggctgctggggtgctctctgttaacacttcctgtctcagtatactcattaccagcgctctgtcactcttaagaatatcacagtttggacagtaaatttgtatacttaatctattaacaccagaagcgctaaaaatgcgtgaaacgccatcttagagcttaaagaatgatcataaaagggtacccggcacctgaccctcaaggccacagataggttgggcagcccccagaagctcccacctgcccgcttctggttcatttcttccttgtaaccatgtggggtggaagcgtggccggcccgc

SEQ ID NO: 11442 - DNA, 2728 bp, Homo sapiens
ccagggggacagcaatccacccagggaccccggagtggagatgacagtgttccggaaagtcagttccacacccccggtgcgctgcagctcccagcactctgtgtttggcttcaaccaggtctcggagctgctgccccgaatggaggactctgggccccttagagacatcaaggagctggtgcgggagcagggcagcaacaatgtgatcgtgacttctgccgaccgagagatgctgaagctcagctcgcaggagaaactgattggagaccttccccagacgcctccaggggctgtcccagacccctctcttgccagtacagactcttcagagccttctcccctggctggagatggagcgccctggagtgggagcagcatggctgacactcccatgagccccctgctgaaggggagcctcagccaggagctgagcaagagcttcctgaccctgacccggcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggagcggccgaggagactggcaggcgggaccgctcaagcagtgtgaggcggacccaggccattcggagacgccacaatgcaggcagcaaccccacccctccagcctctgtcatgggctcgccgcccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgcagtgcactatttctacgatgagagcgggaccgacactcgcattcctccagcttccactcggctgatgtccctgaggctacaggcggcctgaacctgctgcagccgaggcctgtggttctgcagggcatgcaggtgcgccgggtgcccctggagatcccggaggagcagacactgatggaagaagcgccaccccgggcccagcatagttacaagtactggcttctccctggccgctggacctctgtgcgctatgagcggcttgccctgctggctctgctggaccggacgcggggagtgctggagaacatcttcggcgtgggcctgagcagccttgtggccttcctgggctacctgctgctgctcaagggcttcttcactgacatctgggtcttccagttctgcctggtcatcgcctcctgccagtactccttgctgaagagcgtgcagcctgatgcggcgtcccccatgcacggccacaactgggtgatcgcgtacagccgtcctgtctacttctgcatctgctgtctgctcatctggctgctggacgccctgggctcagctcagcccttcccacctgtctccctctacggcctcacgctcttctctgcctccttcttcttctgtgcccgagacgtggccactgtgttcaccctgtgcttccccttcgtcttcctcctgggcctcctgccccaggtcaacacctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatc

SEQ ID NO: 11443 - DNA, 328 bp, Homo sapiens
gtctgcactctttttgtttcttcttttgctcagtataacctgtgtaagggttgtccatgttacagcaatgtatcaataatttttttcattgtattactaatattcctttatatgaatacaccacaatttgtttagcccttctcttattgatggacgttagctgttgtgattaaagctgttgtgacattaatgtataaatctttttgtggacatatattgtcattgctcttggataaatacctaggagtaaaatttctctttcaaaaaaccacctttcaaagttgtacgttcccactagcaaagtatgaaagttgtggttgctccatat

SEQ ID NO: 11444 - DNA, 420 bp, Homo sapiens
ttgggatgcagtgctaaattccgtaatcgtgtgaggttatctgaggaattaaaggaattgaggtctattgctgaggtacagtgtctatttgtacagtagaaggattcattctaggaatggcactgagaagatgcagtcagaaaagaagaaatgccaagctgggtagacattcaagagattctgtggatttctgtggacataaaataccccttcatacaaaattaaaaatgcagttttctaattatgttgtctagacactattgaagtattccaatttcctttattattatatctcaatgattttagaaattatatgacaatttgggttacttgagtgcaaatacctacatatgtgtgtatataatgtgaggacagaagataaagggaatttgtttaattacactatatgtatgttctggc

SEQ ID NO: 11445 - DNA, 326 bp, Homo sapiens
aattcaatctggaatcagaaagcagtggattctggcaaatggtccttgtgccctccccactcatccttggtctggtcccctgttgcccatagccctttaccctgagcaccacccaacagactggggaccagccccctcgcctgcctgtgtctctccccaaacccctttagatggggagggaagaggaggagaggggaggggacctgccccctcctcaggcatctgggaaggccctgcccccatgggctttacccttccctgagggctctctccccgacacatttgttaaaatcaaacctgaataaaactacaagtttaatatgaaa

SEQ ID NO: 11446 - DNA, 442 bp, Homo sapiens
gttggaaacttaaaccccgttacgtagtacgtaacgggaggtgttgcctagtgggaggtgtttaggtcatgagggctctaccctcgtgaattgattaataccattattgtaggagtggtttcattattgtgggagtgggttatatctaaaagtaggttcagccccctattgccctctcttactcttgcccttctgccttccaccatgggacgatgcagtaataagcccctcaccagatatgaccccttgatcttacacttcctagcctccataactgtgagccaaataaatttctgtttagtcaccaaagggaaaggtactaattaagtgccttctttgtaccaagtaatatgtcaggtactttgcagttaaatgacacttaaatgctgtgaagttcataatgttaatgtcgacgcggcccgcaatttagtagtagtagtcg

SEQ ID NO: 11447 - DNA, 591 bp, Homo sapiens
gcggccgctactactactactaaattcgcggccggtcgaccccattaggtcctacgtaacgggaggtgttgcctagtgggaggtgtttaggtcatgagggctctaccctcgtgaattgattaataccattattgtaggagtggtttcattattgtgggagtgggttatatctaaaagtaggttcagccccctattgccctctcttactcttgcccttctgccttccaccatgggacgatgcagtaataagcccctcaccagatatgaccccttgatcttacacttcctagcctccataactgtgagccaaataaatttctgtttagtcaccaaagggaaaggtactaattaagtgccttctttgtaccaagtaatatgtcaggtactttgcagttaaatgacacttaaatgctgtgaagttcataatgttaacaggtagtaaagatggggattaaagagctgagagtataactgcaagtccaggcattgttacattacagctgactcatactaagtggaccatataggcagtggaatgtaggcaggaaatccctatcggtttaaaaatttcacccttttatggaaggaaca

SEQ ID NO: 11448 - DNA, 262 bp, Homo sapiens
tgagaggttcagacttcctcgtggggagagtttacagcagagaaatgacaagatcagggtcagcttttagaaccatccctccaggaggcgcggggaagcctggtgtgatagtctggagctccccagtggtgaggcggcaacactgtgcgacactcaccctgctcagtccagcagtaactcacctaaacctcactgcaaccctaggaggaacagagagaggttaaggaacttgcccaaggtcacacagctagccagttacaga

SEQ ID NO: 11449 - DNA, 1034 bp, Homo sapiens
atgattgttttccactctgcctcccttttaaagatgtcacaacctgccatttataatgcagagcggtttctcgctccatctctcctattttctaacctgttaacaaaaaccctcctgcagacagcaccttttggcatctgcctgcggaggtgtgggatttggccttgcacgttgggttttatgcagtgtttttctaagtattttaattatcttttccaattttatattggccctttagacctctcactactcaaaccttccatcacggttcatttattactgtctgctgaaaagatgatgtgttagaataaattctcattctcgtttttgaggagcagggcaaaaaaaaaagacttgtctctggcttttttcctattttatttcttgtttctttcttgaagtaacgaacaataatttgtgataaaagaatacagacaagacacctgattatccacatggcagtgtcactgcaggtcccatcacctgcaagctcgcttgctgggccgctagggagcacttggcagtggcagctcccttgtcctggggaaggccctgagaaatcagatactccgttggtactctgtgttctctcgggacatcattttccacttcagaactgtctgttctttttgttcagctacaagtaaacttttgggaacttggcttcccttcagtgattgctagcttttattgctacattgaaataataggtcttggcatttgaaatttgattttatgacaaaaggatatgtcaatcacctagaaaggaagagaaatttatacatgaaattgacataatgagcatacctaacaaatttattctagttaatacattctacttataaaagatatttatagatccttaaatatctaatttgcaattactttttagtgttagtctagcaggtgtatcaatgaaaacttagctgatgtttattaatatcacaaacatgacatttttgctataataatagcaaaatttaacccgttactctttaaccttgtactggaaattctaagcagtgcagcaaaaa

SEQ ID NO: 11450 - DNA, 284 bp, Homo sapiens
ctggatccaagaaactccagtccacctctggttgggatggaattgtgtgtgtgtgtgtgtgtgtgtgtgtgtgtgtggtggagggggcttggccctggaaggcactgcttctggagtgtgccctagttctcataaataaacccatgttgtttctgagacctagtcctcacattgtatattgattctagcacagaactcccagctccttatgctcaagtccctgtttgccttcctgtttagttccctaattctgtacagaatggagaaacccacctgcttatgct

SEQ ID NO: 11451 - DNA, 435 bp, Homo sapiens
gagcaggtgttaagactctgccttcaggccctgaggggtcagggtagtgggaccaccatcagtgcaggtgggaagaggctgaatgtagcaagccatcctgagaatagcaccagccatgagctgagagccaagaagtctggcagcaggcaagggagtggcactttttttttttttttgagtggtagcaaggtttattgtgaagagtgaaagaacaaagcttccacagcgtggaaggggacccgagcgggttgcccgggagtggtacttctttgcccattggtagatcaaaaggccattttgggcccaagcaacccctatacctgggctaagggagtgcatcatgtgggcagggccttattttggcctcacttgttcatttcatagcctcttggtcaaggcagggttggggctcagcatgacccaggagaaagggag

SEQ ID NO: 11452 - DNA, 448 bp, Homo sapiens
tttgtggaacaataacattattcattttacagtgaatttattctgattcctattttgaaataactggataaatggactttgcatagagcagtatcttccatatttttacttatagggacccctacataaaaataagttcccctctacatgataatgtgtatagttttgtcataatttcacagtactgtttatatacttaccataaatttaccacagactgatggatgtaatatacccagtgcatgaggatttaaagaaccttagtgataacttcacagttttataagctgggactcattattatagtagtggtttaaatacgtggagagggtcaggtgtggtggttcatgcctgtaatcctgctactttggaggttgaggtgggaggattgcttgaggccaggagttcgagactagcctgagcaatatagtgagaccttgtgtctaca

SEQ ID NO: 11453 - DNA, 353 bp, Homo sapiens
ttttttttggaatgaagtttcgctcttgttgcccaggctggagcgcaatggcgcgatctcggctcactgcaacctctgcctccccagttcaagcgattctcctgcttcagcctcctgagtatctgggattacaggcgcccaccaccacgcccggctaattttcgtttatttagtagagacggggtttcaccatgttgatcaggctggtcttagtcttctgacctcaggtgatccacccgcctcggcctcccaaagtgctgggattacaggtgtgagccaccacgcctggctgtgcaacatgtttctaagtgaacagtatgacttcagagagtcatactgttttaagagagtta

SEQ ID NO: 11454 - DNA, 984 bp, Homo sapiens
ctccgagttcccctggctctgaccgcgctggcctgggccggagagcccaggaggcgtgtctcagagaaaagatataagcggcccccggacgctaaagcggtgccagcggcggagtctccaactgggagagctgcagctgccgagaggaggagaacgctgaggtcggtcggaccaacggacgcgctgaccgctgccaactgcagctcgcgctgcctcctgctcgcgccgtgccactaaggtcactcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctcctaggaactgtgggagaccagcggagtgggagggagacgcagtagacagagacagaccgagaaggaagggagagacagagggggcgcgcgcacaggagcctgactccgctgggagagtgcaggagcacgtgctgttttttatttggacttaacttcagagaaaccgctgacatctagaactgacctaccacaagcatccaccaaaggagtttgggattgagttttgctgctgtgcagcactgcattgtcatgacatttccaacactgtgtgaattatctaaatgcgtctaccattttgcactagggaggaaggataaatgctttttatgttattattattaattattacaatgaccaccattttgcattttgaaataaaaaactttttataccataaactcatgta

SEQ ID NO: 11455 - DNA, 797 bp, Homo sapiens
ctccgagttcccctggctctgaccgcgctggcctgggccggagagcccaggaggcgtgtctcagagaaaagatataagcggcccccggacgctaaagcggtgccagcggcggagtctccaactgggagagctgcagctgccgagaggaggagaacgctgaggtcggtcggaccaacggacgcgctgaccgctgccaactgcagctcgcgctgcctcctgctcgcgccgtgccactaaggtcactcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcacggagtgggagggagacgcagtagacagagacagaccgagaaggaagggagagacagagggggcgcgcgcacaggagcctgactccgctgggagagtgcaggagcacgtgctgttttttatttggacttaacttcagagaaaccgctgacatctagaactgacctaccacaagcatccaccaaaggagtttgggattgagttttgctgctgtgcagcactgcattgtcatgacatttccaacactgtgtgaattatctaaatgcgtctaccattttgcactagggaggaaggataaatgctttttatgttattattattaattattacaatgaccaccattttgcattttgaaataaaaaactttttataccataaactcatgta

SEQ ID NO: 11456 - DNA, 790 bp, Homo sapiens
gcggagtctccaactgggagagctgcagctgccgagaggaggagaacgctgaggtcggtcggaccaacggacgcgctgaccgctgccaactgcagctcgcgctgcctcctgctcgcgccgtgccactaaggtagtccgcctttctatgagccctccccaagattagctgggtgcggggtggtgggagccgttctttggtggctgaagcccctctcctgctgctcctcctgcaggtcactcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctcctaggaactgtgggagaccagcggagtgggagggagacgcagtagacagagacagaccgagaaggaagggagagacagagggggcgcgcgcacaggagcctgactccgctgggagagtgcaggagcacgtgctgttttttatttggacttaacttcagagaaaccgctgacatctagaactgacctaccacaagcatccaccaaaggagtttgggat

SEQ ID NO: 11457 - DNA, 1626 bp, Homo sapiens
atgaccttctacagtgaggtgaaacaaatagagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcgtggaggagatcgaacaggcacccacatgtctcgggcaaaaatcacatctgaacttgctaaagttatcaatgatggcttatattattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctgag

SEQ ID NO: 11458 - DNA, 479 bp, Homo sapiens
gcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcaggtctgtggttgctctgcgttgggcactggcagggtgcgggcaggggcgacttgcgggacttgccggcgcgtggcggcggtagcgggcaccaggcccgggtaacggcaggcct

SEQ ID NO: 11459 - DNA, 358 bp, Homo sapiens
ggagaggacggggccggcgggcggttggcgctccgttcggtgcggggaggggcgtcacgccgggcgctgcgcggcctcggcgggcggcggcagcggcggccacggccgccgggctctcgggttgtctgtccccagttggagccggccggtgtcccggcggagagacgggcagtcgggttccctggcctcggggccaccccggctggggcggctggggcagagggacgatgtctactcgcgccccgatgcccgccgcccattctcgggaggatccgcccgcggtgactgctgagagggagtcgctgttggccgcggcgaaccggccggccgagcagccgcccccgcccgaatgtgaggg

SEQ ID NO: 11460 - DNA, 2460 bp, Homo sapiens
gcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11461 - DNA, 2227 bp, Homo sapiens
gctctcgggccgcccctcttcgccgtctccacgcctccgcgggcagttaccagctttggctgctcgcgcctccccaactcgggtaaagctcctcggcctcggcgtgctgcgcctccgcggctgccctgcgccagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11462 - DNA, 2715 bp, Homo sapiens
gcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaatttgatgcaaacactgaagaaaagggcctttttgtgggcagaaagtgcttgacatgtggctgtcaacttcataccactattactgtcttttttgtaacttttgctgccaagtcccttctgagacctgacagtggacatgcaactccatgtcaggataatcggcctccagtgtgctcatacaagtgagggaggagcagagctacttcagtgttgacaaaatttctgatcatgcagtgtagaatccagagcctctaagtgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11463 - DNA, 2319 bp, Homo sapiens
gcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagaggttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11464 - DNA, 4268 bp, Homo sapiens
gcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcgtggaggagatcgaacaggcacccacatgtctcgggcaaaaatcacatctgaacttgctaaagttatcaatgatggcttatattattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaaggaggtgttcaaggagtgcttcacattcccaagaaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccatgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctg

SEQ ID NO: 11465 - DNA, 2202 bp, Homo sapiens
  misc_feature (7)..(7): n is a, c, g, or t
aagagangcgaaacttaggctaggtacgaggctgggtggcgcgcctccccaactcgggtaaagctcctcggcctcggcgtgctgcgcctccgcggctgccctgcgccagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11466 - DNA, 2188 bp, Homo sapiens
atggtactgccggaatttagggatgcgcgcctccccaactcgggtaaagctcctcggcctcggcgtgctgcgcctccgcggctgccctgcgccagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11467 - DNA, 2406 bp, Homo sapiens
gacccagctttagggcctaagggcaaatcgagcgctcggtcctcccagcgccatgtgcgcggcccgcccaggcccttggccgccgtcgccgcgggggcaggccgcgagccagccgcgagccacagaggcctggtgcgcgccccgcccctgagcctgcagtcggggcggcctcagccagtgagccgggagtcgtccccttcgtcctccctcgcactcggagggcagctggggcggggcagaccctcgggccgggcggcacccgggcgggcgaatccgtcagctcccgcgggaggcccggcgagagaaggacccgaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11468 - DNA, 2261 bp, Homo sapiens
ggagaggacggggccggcgggcggttggcgctccgttcggtgcggggaggggcgtcacgccgggcgtgctgccgcctaagggaaatccctggaccaaaaagcctccccagcacctgtccccagacacgacaggtccgccaccgcccccgctggaaaccctggaggcagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11469 - DNA, 1700 bp, Homo sapiens
cggcacgaggggaatttatagaccataatctaggtgctaggaagcttactctttctgggttgttactgttcctagatctttgaaaatttctttcacaaaggtactggatttaacacatttttcagtatatgttcatgtttttatctctaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11470 - DNA, 1952 bp, Homo sapiens
atgaccttctacagtgaggtgaaacaaatagagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcaaaaaaagta

SEQ ID NO: 11471 - DNA, 2134 bp, Homo sapiens
gcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcgtggaggagatcgaacaggcacccacatgtctcgggcaaaaatcacatctgaacttgctaaagttatcaatgatggcttatattattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctgag

SEQ ID NO: 11472 - DNA, 2024 bp, Homo sapiens
gcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcagaattcggttccctcaaaattataaaagcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagagatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcgttgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcgtggaggagatcgaacaggcacccacatgtctcgggcaaaaatcacatctgaacttgctaaagttatcaatgatggcttatattattatgaacaggatctatggatggaagaagatgaaaacaaacacacagccataaaggtgacaatactgagaacgccctttctcgtatgaaagaataaaaacaagttactgtg

SEQ ID NO: 11473 - DNA, 336 bp, Homo sapiens
aagcagataaattatctcccgcttagcagtgcagtctggagatatggtgcccatgtggcccctgggaagaagtccagggagagggagtgctcactgccttccctcccttctccctccctccctcgccgccatcctcccttccacagcacttagaataaatgcaggactcacaggggctgaaagatcttcctctcccctagtgattgctgctcaccggtctttagactgctctgacatgtggatgacaatcggctgagccactgatagagaagttttcccttttaatcatgtccctgtcattgctaactgcagagtctcagctttgccatgcatgag

SEQ ID NO: 11474 - DNA, 366 bp, Homo sapiens
acggggcctctacctggcctgtgccatgtcgcctgcacacgtgaatacaaagaaaagggaataggaggccacgcgtggtagctgatgcctgtaatcctagcacattcggaggccaaggacgatggatcacgagaggtcaggagttcaagaccagcctggccaagatgctgaaaccccgcctctactaaaaaaaaaaaacacgaaaaaaaaattagccatgcgtggtggtgggcacctgtaatctcagctactcaggaggctgagggagataattgcttgaacccaggaggtggagggtgtagtgagctgagaatgcaccactgcactccagcctgagtgacagagcgggattccatctgaaaaaac

SEQ ID NO: 11475 - DNA, 448 bp, Homo sapiens
tagtatttattaattgtgaagcatctaactaatgcaaacacttaagacaactgcaaatttgatttttcaatgttcaagtttaatttcaacagttttcaaaatctgaaattgccttcctaaattcatctgcattgtatacatccataaagagcacacactgaaaagatacacttccttgtatcttaagaaagggggaggcctggtgcagtggctcacacctgtaatcccagtattttgggaggccgaggcaggtggatcacaaggtcaggagttcaagaccagcctggccaacacagtgaaaccccgtctctactaaaaacacaaaaattagccaggcatggtggtggctgcctgtaattccaactacttgggaggctgaagcaggagaatcacttgaacctgggagtggaggtttcggtgagctgagatcgtgccactgcactccagc

SEQ ID NO: 11476 - DNA, 565 bp, Homo sapiens
tttatctgccctcaagacatatcagcgtgaaaaatgtcatagatttgatgctggctggggagagagatggaaggagaatgctgcctctctgaaccattagcatatctttgtattttgtactcaaactaatctcataggtttgtttctctacctactagggtcagtttgtttttctgctgtaggaactaaatagctcaggattcgtagtatagaatcacagtatagtatcacagcttcccctttttctatgtcagaaaccatgatgtgtttcaaggctagctaaattactgtttgttaatgttaagcatttttcagaggtgagattgtagtttaagggttttggatacatatttcacatattttaagcattttattttgcttaagtctacttaaatgtttttaaacctttattgtgatatgtagcatccataaagaaaagtatacaaaaaacatacatacatattcacatacatccaggaattattatgaagcaaatacccagataccacaacctagttcaagaactagaacattatcagcatcccagaagccatccttcctccct

SEQ ID NO: 11477 - DNA, 457 bp, Homo sapiens
ctaaaacagatagcaatgcactgggggtccataaaaactagtgccaattaagaataaagaaattactcagtgctgcccaaaagtatacaaaaaggcactttatatactgttgacaaaagtagaaattagtacatgctaaatagaaaataacttggtaatatgtgacaacaggccttcagttatacttcctgcacttgtaatttcactttctatttctgggaatatcctaaagccacagttctcaaactttcgggcaccagagaccagaggcggagctcaggcagaaatgctcacttgtcgctcacctcctgctgtgcagcacagctcctaacaggccatggaccagtaccggtccatggtctgggagttgcggacccctatcctaaaggaaatcattagagattcacacaaaaaaatagaggacagtcatcatggtggtatggataacagaaaaaaa

SEQ ID NO: 11478 - DNA, 265 bp, Homo sapiens
taaatgcttattgggtgattatgagaaccaagatgttagatattacagagaaataaagaaacaacttttgctctcagagagattaagcctagcataaaaattttaaaatgcaatttttatattttattctactatgatcattttggtaatatatcagtgattttatctgtgtgttaataagcttttaaaacccatttaaaatttttactgttcaaataaaaaggccatattgtattatttccttttgtaggtttactaatacaaa

SEQ ID NO: 11479 - DNA, 555 bp, Homo sapiens
ttttttttttttgagaaggagtctcactctgttgcccaggctggaatgcagtggcacgatctcagctcactgcaatctccgcctcccgggttcatgccattctcctgcctcagccttccgaggagctgggactacaggcgcccgccaccacgcccagctaattttttgtatttctagtagagacggggtttcaccgtcttagccaggatggtcttgatctcctgacctcatgatctgcccacctcagcctcccaaagtgctgggattacaggtgtgagccaccgcacccagcccgcaaatcaggactttaagccttggtctttaattttagagtctaaaaatgaaacaactttacatgagaaatgtttagaaagaaatgaaacttcttctaggataaattacttgtttaaattctaaaagtcccaaggcagtagtttccaaactctgctttgcattagaatcacctcaggagtttaaaaaaatcctagtggccagggtgcaccccatattaatgacaccagcatgtctggcttggggccaggcagccacaaacct

SEQ ID NO: 11480 - DNA, 342 bp, Homo sapiens
actggaagaaacataaaaataattttcaaacctttaaacaggtcttttaaaataatacactcagacaaaaataaggagaaaagaataaaaaagaatgaagactttgtttccaactacatgaagtaactaaactttaaaattatcagtgtttctgaggaagaaaaaacatcaaaaagtttagaaaacctatttaagaaaacaattgatgaaaactttccaactctagcaatagaattagacatacatacacaggaagctcagcaaacaaaatacaacaaaatataaacaaaatatattgcaaaacagacatcataatggcacatgataatcagaatatctaaa

SEQ ID NO: 11481 - DNA, 326 bp, Homo sapiens
accatcaaaagccagcttgggaggcacatgtggggacagagaacccattagctggagcggggggttggtggggttacattgttagagctgagacctccaagaacaagaaggtgccatgtgaaagagggaagagggcaagtggatgttaccagcgctgttgtttgtaatagcaaaaaataaaaaccatccaaatgttcatcaacatggacttcagatactatatcgtggtattaacatattcatataagggaagaatgcccagcagtgccaacgaatggcagctgcctgcctcaatgcagatgggtcgccaatgcacactgtgcaag

SEQ ID NO: 11482 - DNA, 731 bp, Homo sapiens
gttgtatgttaattcataaacttggattataattagtttgtcgatttaaaatggtgtttgaggttgcttgaattatttttcaaacattatcataaaaatacccacccaccccctgggaagttcgcttcataaagaacttcagtgcaacccgtatgtaaaattaaaatacatttaaaataattggacaaaccaatttaaatgttgctacaaccccatttaatctgtaaattgcatgtgctgctgctttccatggtaatgttggtgtggaatatgtttggaaaaaaggcagtagtgtctgaagctgagttgctggcattgaaaaagcagagtgtctggaaggatggcttcctatttagcagtggtgttgttcctgtttataaatatttgtacttagtggctttgttgataaaatactttgcttggagtatcaaagaaatattaggtaacagaaatacttcttggtaattttgcgatgggatatctgtttctcttgcccacaaattaggcttcacctggatggaagcttgcttgtgatgtaaaataacttctgtgttattaaattttaaatttatatgatacagttttctgtgaaatgacaatattgtctttagaactttgattactgatgaaaagaagtgataccattttgtaaccctaaatccatttaaaaataaatggtacacatattttaacattatgataaataagttgaataaattggtattacttgg

SEQ ID NO: 11483 - DNA, 328 bp, Homo sapiens
gctcctgagttctccctggagccaggggtgtgcgaatgacagaggattgggatcctggtgcccccaaggggagaggcgcttcctccagggtgggcctgtcgtgccgtccatcctcactccgggagatgctcagggatggatggagagcccttcccgttctcccggttctgctgccacaggagccttctcagccgtgcacggcaccctggtcccactttgccagcctgagggcctctgggttcaattccccccacggtgggcgaggtccccttccccagcccagctcaggcctccagactgggatggggtgccgtcggcccagtgctgc

SEQ ID NO: 11484 - DNA, 671 bp, Homo sapiens
attcactattataattcaaataatcattttaataatatataactatgttttctactcagtaattaagtagtaatgctagttacaagattgaaaaagtattcttgaaaatcctcagtttatgaactgaagtttgatgttataacaagatacatattcaaaccaccaccctcaggtacagttaatgtagtagactgcactctgaaatatcgcttgagccggggaggcgaaggcgacagtgagccgagatcacgccactgcactccagcctgggtgacagagagagaaaccctgtctcaaaaaaaaaaaaaaaaaaagaaaaagaaaaaggaaacaagtttagagaggtgaagtgacttacccaagatcatgtaaccagcagctgcaggaacctagttttcgaactctgttctccatgtcttcttgttctttttaattatccaccatgtctattggcccgtgtgtttccaggattcttgatgtttcttctgagctccagggtcaggcagtatgattgaagtttctaagccaggtaagccttgtccagcatttgtccttgggggactttgtttgaattcatggatggcccaggccttgattctcagggaaagtgtgttatctgaaggtcagattgaaggttccaactaaatttactttgtccccttgtcccagca

SEQ ID NO: 11485 - DNA, 678 bp, Homo sapiens
agtcaccgttcacacttaccttggaagagctattacaaaacttctaacgccaaagccttattcagaataaggacattttaaaaacagtacttgatggagtgatgcaagcttgcagtcccagcagtatagtcaggagactgaggctggaggatcagagggctggagcccagggttcaaggccagcctaagcaacatagcaagaccccatctcaaaaataagtaaataataaataaaaataaaaagagcacattatcttttgatttaaattttatttatatcaaaatgacataaatttttgaactttattttttaattttaaaatttttaattattatggatacataatagttgtaagactttttgttttttaattaaagttttctaaggctgggcgcagtagctcatgtctgtagtcccagcactttgggaggctgaggcgaaagaagcacttgagcccaggaatttgagaccagcctgggcaacatagcaagaccccatctctacaaaaaaatttaaaaattagccaagtgtggtggcacgcacctgtggtcccagctacaagggacgctgaagtgagaggatcacttgagcctggaaggtagaggctgcagtgagctctgatcatgacaccgtactccagcctgggtgacagagtgagaccctgtctccaaaaaaaa

SEQ ID NO: 11486 - DNA, 579 bp, Homo sapiens
aatttgagttaatttttgcctctgatgagagatacacgtccaaattggctcttttgcatgtggagatccagttgtcccagtgccgccattattgaaatgactattctttcctctactgaatggtctaggaacaatatgttttcggcataaactgatatatataatagatgtatcctattctttttaatattataatttttgtccacttaaaaaaatactcttaataataaagcattcatgtatttaacaaatatgcaccaagagtcttcctgggcacacacagtgaataggacacagttcctgggctccaggagcctacattccagagagggagagacagtgaaggagcagggaaggaactcaacaaaacaacgggtgatgagagctctaagagcaaacagatcagacagaggtgggaatacgggactgggtaagcatgtgctttggatcagaaggggcgcagagtcctcccagaggaatcagagatcagctgcgccaagtctctgaggctggaaccagcttggcttgctggatgaactgggaaaaagaggtggggtgcgggggaggggtggggggggc

SEQ ID NO: 11487 - DNA, 599 bp, Homo sapiens
ctgcactccagcctgggcaacagagtgagaccctgtctcaaaaaagagtttgagtgctatgctaaggagactggagttgatcctataggcaaaaatgagccattgaagaaagttaagcaaggggtaagacatgactggatttacatgctagaaatatcactcttgaaacagtgtggaggaggaattaaggaatcagaattgtgggcagggagactagtaaggaagctattgcaaaaatctaagaggagggacaaagacaggtctgaactagaacaaccaagcagtggagataaaaaggaagagaccaaaaaacgagtgaaaaggtgggtggtgaaggtgagctgggagggccgttgccttctacctgcttgctatgaaattccagctggaactcagactggctccccacctggctgcatgcaaggaactgctctgatgcagggcactgggttcccaagccccacaggtttgcttcagatgatttctagggaaagggtagatcttcctgaccctccattctcttctcagctgattccaagtcccagatcaatgggatccccttcagcccaactgtttcctgtccttgggtctgacattgg

SEQ ID NO: 11488 - DNA, 377 bp, Homo sapiens
tgagactggcgtctcactctgttacccaggctggagtgcagaggcatgatcttggctcactgcaactgtactccagcctgggcatcagatcaagactctgtctccaaaaaaataataataataataattgtaggactgctctgatcctattacatgcttaagttaccgtgcatttacagagaacaatggtttgctgaaaacactgggaaaccatagattaagataattatgccttccaagtttatgaatatcaacattctagactttttaaaaaatgcccaaaagtatttaagcaataaacacctaaactgtaaggcagcttttgcttcaaatattatggcaaacacataaaatgagtgttacagttgttcttgttc

SEQ ID NO: 11489 - DNA, 1377 bp, Homo sapiens
gacaattctgccatcatgaaccatattccaaacctaaatatgtaagaacatagaaagattattttagcaggagaattttaacacacacacacactttattctgaaaatttagcaacaaaatgaaaggtgagttgtggtagttgatgtatcaacaaatagaaagaagaaagcctgtaatctgtttcagaatgctatttctggggctggtaacatcaaaaataatcaaattaagtgttaacttgctgactcgtaagattttctctaatttagaattggagaacatatatactcctattaccactttccatctttctcaaatatagtttttatagttttctgttggcttcatcatcgtattgaaagattattaatcacttacatatatgtagttttctgttaagtcctgttcagtatattacaaaattttgatctgtgtatgtaatatcaattaataagatggtgttagttaaatcagattacgtgttcattcattaagtcattgttaacacttcacagaatataaatcgtgttccatgagtatgaatttctctctgaattccacataattgtcttaaaattatgcaccatttatcgttaagagtgaaagattatgtgtcatttattgtagtggtagaagaaaataaaaccaaaacagaatccaatccaaaagcttaggtttttgttgctactacagtaattacatcttcatatactaaggacagcacattattactgtccaagaatggtgcctcggacaactggttgcttacactgttttcagagatgaaataggaacataagcaggaagatttttgtctaaatatgaagcaagaaaggcttaaatgtctttattcaggggattaggcatcataagtttttttttttagagaaattggttttcatgatatttcctatctccttttgtcactttgcttttgtcggtaaattttacaactaaatgaggattaccaggcataaaaagcagcagacaatcatgatgcaaactgaaaataatcaatcaaaactgacccagaacttaaatagatgttaaaattagcagaggaggacattaaaactgtttttatacatgtatctcatataatcaaaacattaaatagagacatgggagataaacaagaaaagccaaaatcaaactttcaaagacaaaaacatttgagatgaaaattacattggatgaactaaagcagattagaaactgcagaagaaaagattagcaaacttgaagatacaagaacagacactagctaaagtacaaaaagaaaaaaaaatcttaaaaagtgatttttaaaaagcatcagtgagcagtcaggcaacttcaaatggcctaataatatgcaggtaactggagttcccaaa

SEQ ID NO: 11490 - DNA, 487 bp, Homo sapiens
aaatgcacattatattattccatttatttgaaatccctagaatagacaattctatatacagagaacgtagattagtggttacttggggactagaacagggaggaaggcaggggtgatagttaaaggacacacgaggttttctagaggcaataaacatgctctaaaattgattgtggtgatagttacacaacactttgaagacactaaaaaaaccactgcattatatactttaaatgggtgaaggctattgtgggtgaattgtgttctatctgtatctcagggaagatgttataatgttttaaagtcaatacagcttttacctggtcctcttgggttcccgctcttggaacccagctacccattctctgaagatgccaaaattagccacaaggatctcccatatgtacacattacaacccacagcactagctgaaggcccagtggacagcctgcatcactgctagacaagtcagtgaatcagccctct

SEQ ID NO: 11491 - DNA, 5399 bp, Homo sapiens
  misc_feature (2885)..(2885): n is a, c, g, or t
  misc_feature (3281)..(3281): n is a, c, g, or t
  misc_feature (5320)..(5320): n is a, c, g, or t
gtggcttcctgggcattgccttccaccccagcttccagcacaaccgcaggctctacgtctactactcagtgggtatccgcagcagtgagtggatccgcatcagcgagttcagagtctccgaggatgacgagaacgccgtggaccacagctctgagaggataatcctggaggtcaaagaaccagcctcaaaccacaacgggggccagctgcttttcggggatgacgggtacctctacatcttcactggagatggcgggatggccggagacccctttgggacatttggaaatgcccaaaacaagtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcggcggcaactatggctggcgcgcgcgcgaagggttcgagtgctacgaccgcagcctgtgcgccaacacctctctcaatgacttgctgccgattttcgcctacccgcacacggttggcaagtcggtcacagggggctacgtgtaccggggctgcgagtaccccaacctgaacggcctctacatttttggggatttcatgagcgggcgtctgatgtccctccaagagaacccagggacaggccagtggcagtacagtgagatctgcatgggccacggccagacctgtgagttcccaggcctcatcaacaactactacccgtacatcatctccttcggggaggacgaggccggggagctgtacttcatgtcgacaggggagccgagtgccacagctccacgcggagttgtctacaaaataattgacgcatccaggcgggcaccacctggcaaatgtcagatccagcctgctcaggtgaagatcagaagccgtctcatcccctttgtgcccaaagaaaagttcatcccgaagacacggagcaccccgcggcctacagcgcgggcgcccacgcgggcgccccgccgagggcgccccacggccgctccccccgcgccaaccccgcggccagcgcggcccacccagcagccagggagccggaggggcggcgggcggcggcgggggcggctgaactcggcgagccgggcgttccgggatggcgaggtgcgcctggtgcggcccgcgggcctgagctctggcagcgggcgcgtggaggtgttcgtgggcggacgctggggcaccgtgtgcgacgactcctggaacatcagcggcgccgccgtcgtgtgtcgccagctggggtttgcctacgccgtgcgcgccgtcaagagagccgagttcggccagggcggctcgctgcccattctgctggacgatgtgcgctgcgcgggctgggagcggaacctgctggagtgccagcacaacggcgtgggcacccacaactgcgagcacgacgaggatgcgggcgtcgtgtgcagccaccagaaccccgacctgtaggcaacacgccgctgccccaggccatcccgccggcgggggagcctggcaggggccgctccgccctgtgtgcgcccagcgggtgcacacgtgttctagagtgaagggggtgcgggtgtgtgctgtcctggggacatgtgtgaggcgctgcagtgcatgtgtgtcctctgcagacccaaggcaggagtgtgtgttgggggcggtgtgggctctggaagtgcatggtccatcatgggcgggaggagttcctttcttacctccaagcgtttcagacaccagcaggaacagcagccgggctgtgggaccctgaggagggagggcagccaggcttcgaggacggacatggcccctggctgtgctaacagaggcacagcttgcagactgagggcggtggggagaaccaggcttgtcctgcccacagctggaatggaaggtgcaagaacagccggagggtggcctgaggaatgtggcccggacagcatggcctggtgcccgcatcccccccaccccctggcagtcagaggcgctggagagaaccggaaggcatccagtggggaagggaaagccttctggaaggtgggagcagggtgagctgcaggcctggggccccactggaggggcaggctgcgtggaggagccagcacctgctcagggaggatggctgtgaggactggatgacctccaaggccgtatgctggagaagccactcagcagcatactcagtccttgtgggtgctcctgggatgggaccagcctcctccaaccctgaggcctgattctctcttgctcttggggcagaagccacccacactagctgggcagagctttcaccctggccctccagtgagtcggtgggcctccactactttcaaagctgtgtttgggccctggggccacctctgtcctttccatccccatccctgctcagtgtaaacccaggagacctgattcctccagccctacctcggggctgaccaggctgggggtccagtgaaactactgacactttttcacccagggctatgccaataatgtggctgtttacacaccactttcctgcctcctctctgacctgcacctgtgtgggagccggggtgggaaccaggagaaaggggtgaggcctcccgcttcccacctgcatcacaggtggaagctccttcactccagggatgctcggccctggctctgtgccaggccgcagaggggcacttagtatgactgcgctcagcctcggatgggagcacgggtgggggtgggtaagcagatgagtcaccaggcagtgangacaggatgtggcccatgtcgggggttggaagaggtctgggtggggcacccaaacccaacctatgggggggctttgggagggggtgatgctgtgccaagttctgggagctggcaccaggggtggctgggcaggccttggggcaggcatgagtctggcagggtctcctagctgctagtatagggtctcctagccactagtataggatcctgggctgcagcagaaagctttaggtcactgtcttggactcctcatactctgtgctttacagaatgggaaactgaggcacacagaggttagatatcttagggcaccaagccagggaagggagaagtcaagtttgaatacagcagcttagtttagagtccccgcaccctaaccactgccctccccagctncactatgcctgcagagagcggtgtgctggggctcctgcctggtgtgggagtgccagcctggctgggaagcagctgatggagatccctgggggctcctcttgcctggcaggtgcccccgctgctggcctcatgctcctctcgggcctccagtggcccaggggaggttgagtgggcatcttcctgggatgcaggggagttctgagctctgacgccgggcgtgttaggagatagcaggccgttaatgaccatcccagccgaattcctcactgtgcagatgaggaagtgagctcagggaggctgagtgtcccaggcctgttgccagatgaggccacgctgagactggagccagggaaggtgcagcaagccttgaggccctcaagaatgcagccgagccagggccctgcttgcctggccccagaagctgttttgctcagagctggattaggagggttggcaaagggagctctgggtgcggcctcaggccctccagtacttctctgggcagttcgggctttggccttcagtcttccaggccaggcgctcttcctccccagcctccaactcatcacctctcaggccccaaaccaggcctgggctaggctgcagcctgcctcctggggactcactccacagtccccaggtcagtggtccccaacctttttggcatcatggactggtttcatgtaagacaatttttccatggatgggggttggggggatggttttgggatgaaatgtcccacctcagatcatcaggcattagattctcataaggagttcacagcctagatccctcgcatgcacagttcatagtaggtttcatgttcctatgcggatctaatgccactgctgatctggcaggaggcagagctcaggtgggaatgcttgctccccacactaccctgccccactgccactcacctcctgctgtgtggcccggttcctaacaggccacccatcagtactggtccgtggcccagggtttggagacctctgccctaggtagtaataagagtggacagctgttatatgtaaatacttgttccccgatgctggaaagaaatagcactaaaacataaatttaattctttcagcaaggcaattttactttctgcagaaagggtgctcatcgcagatggaacaatagtgagaggacacctgaacaaaggagggaagcaattgttagcccttatgcagtttgtccctgctactgtgtcctatgtccattggcagaagccagaccgcacaatctaaactaaaacccgattggctgtttaaaatttttctaaataggtaaaagtaatggaaggataaaggaaaagaggaagttgcttacgaaaggacttagaaaagtaataatattcccaaataaggaaggggtataggctgtgagctgggacatgcctgtgagcacgtccagcacagatatcttggttaaagtataaggacatagaacgtactatgtgcctgtgagcacgtctaacagttacatagaatagggcttgacaaagagttattagcataaagcaaggaggtttgaaggaagttcgtctttaaaagaaaccattatttctaacacttacgatttattctttaacaagaagggaaactttcaagaggaacttttactttctacaacagctgacctctgctgagcgcttactacatgccaagcactgctctgaaagtttaacataccattcactcatgtaatcctcatattaatgcacatttactcacgtggaagccgagttccagggcatttgtcacttaccaaatgtcacatagccaaaatttgaatttgagcccaggtagtccagctctgggaccctgctgtgggccttcctgctgggccacctcaagggcattgaaagccagccccaccccactgggacacaagttcagagaagggcagagctggctgcctgtccagtgcttctttcactccaccacctacagctggccgctgagggagcattcacatgtgactctgtccccagggactccgatcttgccttaaagtcctccagggcctctgnggatgggggcacagccttcaccctcaccccctccctggattttatagcccacttaccatgcataacagacaagtcccat

SEQ ID NO: 11492 - DNA, 544 bp, Homo sapiens
tttaataatgtatgttccactttcaccctaagaatcagtcatagccagaggctatggcagaagttatagatgtgagtatacacccatctcatgttctttttttctttggttgttcccagtagcaaagaacacacacatacacatgcttcccacttgtttcagaagagaagcggtaaatggaaagtccctagttgtagggcatgccccctgaaatctcatcctttgatgggggatgataggaactacatggcagggaactaggaacccataaatcagtggcctgcaagtttccaagggtactgggtcatcttttatctagcagtggagtggcccagggaggaagcagtataatcatatctgaggagactgttattgctccatctgcttgcctcaagagaaggcaccaggcagcctctcataaccaggagagatggctcttatctttcacctccaggtgtgtctggctgtttcactttctactctatcgcaaccagacacttactcaaatgcaaaccaacacacaatctttatccaaactttgcac

SEQ ID NO: 11493 - DNA, 385 bp, Homo sapiens
ttaagttggcccactgacaaccctgtttgaaggacatgagagagaaacctttaagtgttgtcctagaatagaactagaagatggccggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11494 - DNA, 1178 bp, Homo sapiens
  misc_feature (23)..(23): n is a, c, g, or t
taggctagtcgaggctggtgtgnaatcggccgagggtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctgtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11495 - DNA, 1238 bp, Homo sapiens
gaagttggccgttgaaagagcaacgctgattagtgaatcttaaatcacctaaatgaaagcccacttgtgattcgccctaagtaaaccagagccccgtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctgtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11496 - DNA, 1596 bp, Homo sapiens
  misc_feature (23)..(23): n is a, c, g, or t
taggctagtcgaggctggtgtgnaatcggccgagggtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggtagggttttgtatccagagagggttcagctttctcccgtgggctgggggaagaggtcaaagtagaactcaggtaccaaatttgaaaggaaacactcagaaaaaacttctgagcgcagagcggaaaacaccctctcagtccccaccaaagagaaaagctttgggttctaaatttccagtttccattaagggactctgggactggacatttctgaaaattaatgacctgtactgagtaatcctcctaacacactgatcatcaaaaaataacctgtaatgagtttaggctttctgtatttgtctgaatgctttcacgggagtgtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11497 - DNA, 1275 bp, Homo sapiens
  misc_feature (23)..(23): n is a, c, g, or t
taggctagtcgaggctggtgtgnaatcggccgagggtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11498 - DNA, 1192 bp, Homo sapiens
gaagttggccgttgaaagagcaacgctgattagtgaatcttaaatcacctaaatgaaagcccacttgtgattcgccctaagtaaaccagagccccgtgggctggaacgcgccggaatctgaggtgactgggagttttcgtcctcttgaataagaactcgacaacagagtgggaactttctgtcttgtgatccattgcctgtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11499 - DNA, 1701 bp, Homo sapiens
gccctagagcctttggagggagcacagccctgctgacacctttattttggattgctggcctgtgagaaaataaatttctattttgagctgctaattaggaaactaatagataccccatcgcgcttatatctcacttacccattctgtaacatggctatagtaatacctttctcagaagcttcgctccgggattcaatgagatatgtttgtacggcacttagcacacagtgaatgttcaaaaataaactcgacaacagagtgggaactttctgtcttgtgatccattgcctggtgagtcacagctcacaccatggatttaacctgagagcttcaacttctgctttggccctggagttcccatgccctggtgtcttctaccagttcttaggtagggttttgtatccagagagggttcagctttctcccgtgggctgggggaagaggtcaaagtagaactcaggtaccaaatttgaaaggaaacactcagaaaaaacttctgagcgcagagcggaaaacaccctctcagtccccaccaaagagaaaagctttgggttctaaatttccagtttccattaagggactctgggactggacatttctgaaaattaatgacctgtactgagtaatcctcctaacacactgatcatcaaaaaataacctgtaatgagtttaggctttctgtatttgtctgaatgctttcacgggagtgtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11500 - DNA, 1052 bp, Homo sapiens
  misc_feature (23)..(23): n is a, c, g, or t
taggctagtcgaggctggtgtgnaatcggccgagggtgggctggaacgcgccggaatctgaggtgtgagtagagcctgggggagagtggatccaggtgaagggggcagaggtgtacctgtgcagggatcagtccatttattcctattttctctgacagctggatgaaagggactgggagttttcgtcctcttgaataagaactcgacaacagagtgggaactttctgtcttgtgatccattgcctggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11501 - DNA, 1550 bp, Homo sapiens
  misc_feature (23)..(23): n is a, c, g, or t
taggctagtcgaggctggtgtgnaatcggccgagggtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctgtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataatagctaaagggctgactttcacttcgaactcttggccacggctttttaatcaagttctttaggtttccttgggattagaggaaaggtatggaaatattgttttttgttttttgtcttgccatgtatctgtaggtttttttcttccatgatgtggtgggctgtgtgtgccttatttaattaccatgagtccattttggggtgtcttcacttttcatctttgtagccctttctccaaagctagtgaggaaggtatattctcaacatcagatataactctatacctgtctgatctcccagaccaaatgaaatttgcattaaatggaggggccctggtcaggttccactttggaagtctgatcctgactccctagagc

SEQ ID NO: 11502 - DNA, 1228 bp, Homo sapiens
  misc_feature (23)..(23): n is a, c, g, or t
taggctagtcgaggctggtgtgnaatcggccgagggtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11503 - DNA, 1145 bp, Homo sapiens
gaagttggccgttgaaagagcaacgctgattagtgaatcttaaatcacctaaatgaaagcccacttgtgattcgccctaagtaaaccagagccccgtgggctggaacgcgccggaatctgaggtgactgggagttttcgtcctcttgaataagaactcgacaacagagtgggaactttctgtcttgtgatccattgcctgtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaatacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataata

SEQ ID NO: 11504 - DNA, 1699 bp, Homo sapiens
  misc_feature (23)..(23): n is a, c, g, or t
taggctagtcgaggctggtgtgnaatcggccgagggtgggctggaacgcgccggaatctgaggtgtgagtagagcctgggggagagtggatccaggtgaagggggcagaggtgtacctgtgcagggatcagtccatttattcctattttctctgacagctggatgaaagggtatgtagaaacaaccattaaatgaacacacacatctaaaaggtttgaacaaactctctcagagaaaaacctcacagcattgagcacagaaggaaaacattagccctgtagttgcttttgttgtcagctgctgaactgttcaaatttaaattattttttttcactccagtctacctgctttaaatgccacagatattaagtaaatggacttacccttgaaatcgggttggccaagccatcacttctcaaagaaggtttaatgatggcatgaacccgtttttatattttattgtattgtactcaataacaataatttagctattctaatatgggaaattatcacagatattattctcacatttaaataagataaaaatgactagatgttctctcttcctctatagcagcactctatactatacccagcccttcttttctatgcttagtaagaaaatgtatagtttgcttataaaattatgagctccattcttaaaagagcttgggaatatttatcttattactttaaagccataccatatataaatccaatgtctcacgaactcttaagctactaagggggattgaagggcaacatttctaatggcgccagccagcttcaactaccatttgccctctattctaactgttagagttggtccaagtcttctgggttatttgtgtaatatccagaatagcacaaattaaatttaaatagttgttttcttaagagcagtaccatcagctcagtcaactaagctagaaacttgtgtcatttctaacaccttctcccttgacacagctaagactggaggtcagaccctcatcatctcttatctggagaattgcaatagtttcctaactggtcacccaattcatatgcatcctgctgcccattacctttttaaaaattaaaaattatcacgaaaaatttaaaaacagaaaatagtacattgggtagtataatatctatgttccaccaatcagattaataaatattaacattttggcacaccagctcaagttttttattttaaagaaataaaacatcacagatttagttcagatcccttttatttccactcctaaccccattccctttccttcctccctctgcagaggcaaatagtcttttgaaattgtcatgtattgtttatgcccatgtttttatacttttgctgtatatacgttcgtcagaaacaatatatattactgtttagattgtatttaattttaaaaatacaagtagtatcatactgtgggttccattttgcaacttgtttttgtcactcaacattgtttttgagatatattcacatcaatacatatagatcaatttcattcattttaagtattcattatgaatatataatattgtatctgttccctgattgatggacatttaggttttttcctgatgttttgctattgtaaacaaagctgcaataaacaccttgtacatgtctctttatgcaagactgtgtctagaacagtggttccccaagaagatgttgctgcccgttttagggtgt

SEQ ID NO: 11505 - DNA, 679 bp, Homo sapiens
  misc_feature (23)..(23): n is a, c, g, or t
taggctagtcgaggctggtgtgnaatcggccgagggtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggaattgggaattaccaagaataaatgggaatgcacccagctggtacctgtctaggaagaaggactttgggatgaagaggttgttgacagcaggcctctggacattgttaagggactgaaacatagaatattggctccaaggaagagactgtccagacctaactgatcaaagaagaaattatagacagtgcttttaataatttgtcttttt

SEQ ID NO: 11506 - DNA, 345 bp, Homo sapiens
gtagaattttctaaagtattctgttctaaaaacaacagaagtggaggtggagaggggatgctttggtttttcttgattatgactttgggcagaagtaaaaataaaaactacacatttccattcttaggaattgggaattaccaagaataaatgggaatgcacccagctggtacctgtctaggaagaaggactttgggatgaagaggttgttgacagcaggcctctggacattgttaagggactgaaacatagaatattggctccaaggaagagactgtccagacctaactgatcaaagaagaaattatagacagtgcttttaataatttgtctttttaaccccag

SEQ ID NO: 11507 - DNA, 720 bp, Homo sapiens
gccctagagcctttggagggagcacagccctgctgacacctttattttggattgctggcctgtgagaaaataaatttctattttgagctgctaattaggaaactaatagataccccatcgcgcttatatctcacttacccattctgtaacatggctatagtaatacctttctcagaagcttcgctccgggattcaatgagatatgtttgtacggcacttagcacacagtgaatgttcaaaaatagtgatggctgttcctcttctttaaggactgggagttttcgtcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggtagggttttgtatccagagagggttcagctttctcccgtgggctgggggaagaggtcaaagtagaactcaggtaccaaatttgaaaggaaacactcagaaaaaacttctgagcgcagagcggaaaacaccctctcagtccccaccaaagagaaaagctttgggttctaaatttccagtttccattaagggactctgggactggacatttctgaaaattaatgacctgtactgagtaatcctcctaacacactgatcatcaaaaaataacctgtaatg

SEQ ID NO: 11508 - DNA, 946 bp, Homo sapiens
cggtggaaccaatccgtgcaacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttctcttcattcttcggcacgatgtgctctgtccccggccctggctccccgtgggatcccggcggaccgcccggggccccccggcaccccactccggctcgtgggcccccccccgctgggcccaagttccgaggcccctcacgccgcgttaacccatggggttcccccccgccggcgggatatcgc

SEQ ID NO: 11509 - DNA, 837 bp, Homo sapiens
cggtggaaccaatccgtgcaacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgtgagtagtgagaagccttttggaggaagttacaggtagatctcttaactgccctggggtccgctcaccaagaaccaaacacttcacctctatttagaactcaccagcctgctagcaaatgttcttgccctctccccactttttattgtccatatgcaggaatatattttgaattctttagatgtctttgggctgggtgcagtggtatacgcctgtaatcccagcactttgggaagctgaggtgggtggataacctgaggtca

SEQ ID NO: 11510 - DNA, 1028 bp, Homo sapiens
cggtggaaccaatccgtgcaacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcgtgacgtctacaacccttttgagacccgggaggtgaccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttctcttcattcttcggcacgatgtgctctgtccccggccctggctccccgtgggatcccggcggaccgcccggggccccccggcaccccactccggctcgtgggcccccccccgctgggcccaagttccgaggcccctcacgccgcgttaacccatggggttcccccccgccggcgggatatcgc

SEQ ID NO: 11511 - DNA, 1032 bp, Homo sapiens
cggtggaaccaatccgtgcaacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggtacaggaggtgtgcaggtgagggctggggagaagggccagtcctggggcccagggctcacatctccgtctgctcacactgggcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttctcttcattcttcggcacgatgtgctctgtccccggccctggctccccgtgggatcccggcggaccgcccggggccccccggcaccccactccggctcgtgggcccccccccgctgggcccaagttccgaggcccctcacgccgcgttaacccatggggttcccccccgccggcgggatatcgc

SEQ ID NO: 11512 - DNA, 353 bp, Homo sapiens
ccaccaccagcctatgagcctccagcccctgccccattgcctccaccctcagctccctccttgcagccctcgagaaagctcagccccacagaacctaagaactatggctcatacagcactcaggtacaggaggtgtgcaggtgagggctggggagaagggccagtcctggggcccagggctcacatctccgtctgctcacactgggcaggcctcagctgcagcagccacagctgagctgctgaagaaacaggaggagctcaaccggaaggcagaggagttggaccgaagggagcgagagctgcagcatgctgccctggggggcacagctagtaagtaatagagtggggaagag

SEQ ID NO: 11513 - DNA, 796 bp, Homo sapiens
tatggttttctttctctctcctctcctctccctttctttttttgacatttgactttacagttagaataccttttggggtagaacctcatgttactatttttgcaggtagtcaggtgtctcagcttcatttgttgaataattctcattctccgctgaattgattcagataccacatttttgtttattattgggtctctttcttgttttcagttctgtttttattgatctctttattttttcttctgatttttactgtttgagtatttatttgtataaatttatggtgattgtattttatacaaaaaatgcattcagaaagaaatgtagtctaagtcatttaatatgctttttgaaaaattactcatgtaaaattgagttcagtgagcttttaaaaattgattaaggtatgtattactgccagttatttgatctgtgttgacataatagataatggtttctcttgtcagaaggcaaaaaaatctgaggtggaaataagttaaaggagagaattgactgccttatagtccaaggacagattttcaaaccagctttcactcaggctcagacagcatcaagtttccctcttgccatttgccaccttgccttcctccctattagattcacctgttatacttgacccctgcgtggacccaagatggttgtgctgctggtttcttgtctagcagtagacagaacctgtgtcacagcattcccagtcacccctaaatcacgcatagggggatcaggcccccaccctggaaatggtattgagaccaagcctacacaaactacatag

SEQ ID NO: 11514 - DNA, 346 bp, Homo sapiens
gctatctactgcatatgtcaggtactatgctaggtatagatgctgagaacaaagatactctcattatttgtttccatatctagaagtgaaccactgactacttaagtgttttatctagacagtggccaccaaccacatgtgcatcgctggtttctgaccagtggaaacactatttgcatgaactaggatgtactctaagtataaaacacagtggattttggccgggcgcagtggctcacacctgtaatcccagcactttgggaggccgaagcaggtagatcccgaggtcaggagttcaagaccagcctggccaacatggtgaaaccccatctctactaaagataca

SEQ ID NO: 11515 - DNA, 455 bp, Homo sapiens
gagtatattttcctacttcattgtatgcatagtaatttttgattgcctgctagaaattttgaaatttttcttttttagaaaaaatactgtggaactatgttccaggatgcagttaattacttggatataatgtaatcttttcaaagattccttttaagtttgttggttgggaccagagcagtgttttgtcaaattattttaactactgaggcaaaactcttctcaatgtctaccctgtgacttgagaattatgagatgttctacccttactggtagaaacaaacactactatttctagctctgtgtgagcaactggtgctattccttttaatcctttcaggtggttctttcttgaggtttctttatgtgcatttgtgaatcagtgctctgctaaatactgaaggcaaaccctctgtggatctccacacttctctctttgtgcagctctattccct

SEQ ID NO: 11516 - DNA, 458 bp, Homo sapiens
gcaccgttaaacctcaaaaatcccaattgctttccttttttttttcaaggaaataattttgggtccacccaagagtttactggacattttctgatctatgtttttgtaaataattgcccccatcccctcattatgtagtagaacactgatttagcctttgtaactagtgtgatttttatgccatttagatcagctgtatagtcttgaaacattacttaccctttcagttttcagatttctaaaatggaaataatattggtacctaccttgtaaggtccttttgaatattaaaaagaaccaatgccttaaaataaaaaattaaggcattggctaattgtggtggctcttctctgtaatctcagcactttggaaggccaagacggcagggtcgcttgaagccaggagctcaagaccaacctgggcaacataacgagacactgtttctatgaaaaaaaaaa

SEQ ID NO: 11517 - DNA, 2419 bp, Homo sapiens
acgacttccattgatgtggacttagaaatggcaagagataccttcaagaagttaacaaaaaaggaatggatttcttccatgataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaaagaagtgttgggcatttttgcaagaatcttctctgaatccgctgatccagatgcttaaagcagccatcatctctcagctgcttcatcagactaaaaccgaacaggatcactgtaatgttaaagctcttttaggaatgatgaaagaactgcataaggtaaacaaagctaactgtcgactaccagaaaatactttcaacataaatgaactctccaacttattaaacttttatatagatagaggaagacagctctttcgggataaccacctgatacctgcagaaacccccagtcctgttattttcagtgattttccatttatctttaattcgctatccaaaattaaattattgcaagctgattcacatataaagatgcagatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaaactaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccaccca

SEQ ID NO: 11518 - DNA, 2658 bp, Homo sapiens
acgacttccattgatgtggacttagaaatggcaagagataccttcaagaagttaacaaaaaaggaatggatttcttccatgataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaaagaagtgttgggcatttttgcaagaatcttctctgaatccgctgatccagatgcttaaagcagccatcatctctcagctgcttcatcagactaaaaccgaacaggatcactgtaatgttaaagctcttttaggaatgatgaaagaactgcataaggtaaacaaagctaactgtcgactaccagaaaatactttcaacataaatgaactctccaacttattaaacttttatatagatagaggaagacagctctttcgggataaccacctgatacctgcagaaacccccagtcctgttattttcagtgattttccatttatctttaattcgctatccaaaattaaattattgcaagctgattcacatataaagatgcagatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaaactaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccacccaaaaaaaaaaaaaaaaaaaaaaaaaaaaaaaaaaaaaaagaaaaaaacacacaaagacaaaacaaaaaaaaaaaaaaaaaaaaaaagttgtggggcgcgagccgccgccgggcccacaaaaagaagcttataaaaacagtggtgggggggggccgggcccacccatatgtgaatagcaaggggccgaacgagcgggtacaagagacgcgggaacagacagggggggtgctccccaaaacg

SEQ ID NO: 11519 - DNA, 386 bp, Homo sapiens
aaatgtctatcatagactagaatgccttgcattttaataggtcctcatttcaaatcaaatttcgccggcattattcttgcaacagtcttgccaaatcagtagtactactcctcgttttatggatgagaggtatgggggtcagaaagttcagaaactgaattgtcagggtcgcatggctagcaagaagcaactcaaactctgactgtatgatggggttgtttttcttatgtggggcatatgtcctttcattccccaatagttcagcctgtcctgagaagctcacctctactgatccatacacccatggattttactgattttagtttagtcttggttatcaggtccttaggatgcaggttcccacatcagcatagcttgagtactcc

SEQ ID NO: 11520 - DNA, 424 bp, Homo sapiens
tactactactaaattcgcggccgcgtcgacttttactcagatatacccaggagattttcccactgtcattatttaaagaatgagtccccaatccccaggccacagactgacaggtcctggtccgtggcctgttaggaactgggctgcacaggtggaaatgagcaaaagccagcggtgattattatcacctgagctccgcctcttgtcagatgagccgcggcattagattctcatacaagagcgaagcctattgtgaactacgcatgcgtgggatctatgttgggtattccctgatgatctgaggtcgaacagtttcctctcgaaacaatccccaccccccaaccctgtccgtggaaaaattgtcttttccacaaaactggtccctggtggtcgacgcggccgcgaattagtagtagtaggcggc

SEQ ID NO: 11521 - DNA, 277 bp, Homo sapiens
ctataacctttgcttaaattgtagaaaagatggatttaatgagacaaatgaaaagtggtttaacataacacacagcagagcatatgctgttatgctttggtgtttgttccctagcccttgttcctcataatagattgtggaatgtttcaaaaatgctgtaacttttttttgctaattgtggtcttaacaaaaattgttcttgattttaaaaaaagatggataggattggttattgaactttgatattaaataaagttttagtgatagtatttcaaat

SEQ ID NO: 11522 - DNA, 777 bp, Homo sapiens
ggcgttggagagtgatggcggcatggcggtgcggcggcggctgcgaacaccttgaggacgggtcgcattatgttgcccaggctggacttgaacttctgggctcgagcaattctcccacctcagcctaccaagcagctgggactacaggtctgcaccactgcaccccacccattcaagtccacatccccagaaacgaggataatgcttggcacaaggtaggcatttaatacatatatgttgaatgtatgaataaatatactggctctttctcaaggccagagaagcctctcttcatcttcccaggacttccattacctactttttttctggagggcgggggggaataatttcaacctacagaaaagatgcagatgcaagaataatgaaaggaactcttagataccctttaaccaaattcaccaataatgttttagtttgtaaaatctaatttgaaataatttttttaaaaatttattttctcctcaaatttctttttctttttctttggcttaagaatcttcatgtttttatttatttatttatttattttttgtttttgtttttttgagacagagtctcactctgttgcccagcctggagtgcagtggcattatctagactcactgcaacctccacctcctgtgttcaagtgattcttgtgcctcagcctcctgagtagctgggattaccagtgcacgccaccacgccaggctactttttgtatttttagtagagacagggtttcgccatgttggccagcctggtctcgaactcctg

SEQ ID NO: 11523 - DNA, 1022 bp, Homo sapiens
acctaatgtaaatgacgagttaatgggtgcagcacaccaacatggcccatgtatacatatgtaacaaacctgcacgttgtgcacatgtacctgagaacttaaagtataaaaaaattattaaaaatcattgaaatgtacacttttaaaaaaaagagtgtattctatcaggattctgactagagtgctctagagtatgacataggatagggaatgtcttaacaagcttcaaaattctaggaacaatgaaactaggaaaaaagctttgaaaaatgccagggattcaactgcctccctggcctttccctgccaatcaatgtgccccagcagccaatttacacagcactgtgtgcaggcttgtaaatagaccttccagttctgctataatcaagaccttattgtccataactcaatttagagaaggtttagctgtctaccaactcttgtgcagagtttctgtgaagttttgttttgggttgcaagaatctggaaaacaaatgcagacatttttgaggaagattttgaaatttctatttacaaggtacccaaaatgggatgcaaacttgaatttggttgatcttctgaaatacatacctgtgttttaagatttgcttgagcaaacctttaaccatggaaatttgaaacaatgatttccaggttgaaataattccagttttgtcatataaataccacaaatgaatctgttttagcacagggtacaaatatcttttttccttttgtgcatttggcaatagtgtgttttggtaataaaacatagatctgcatattaatgaaacatagctctgcatattttgtctggggaaaattagcattctgtgaacaaagtcaacaatttctggcctcgcattagttttcctattataattaaaacttagttttggccaggcgtggtggctcatgcctgtaatccccgcaatttgggaggccaaagcaggcggatcacgaggccaggaggtcgagaccatcctggctaacatggtgaaaccccgtctctactaaaaata

SEQ ID NO: 11524 - DNA, 492 bp, Homo sapiens
ctatttttataaaatatgaagacattatttgcctttttcaactttgttgacatttgtactgatgatgcaaaagcaattagggataaaactgctggtggtgccttagcacgaatcaaggcagtaacagcaaacaactctggtagttgtattcttcagaagacaaaaccttagattttccttaagaatgtctgtgatgaaagagtaaaaatttgtcaggtgctgcagctcatgccctgtaatcccagcactctgggaggctgaggcgtgtggatcagttgaggtcaggagttcgagaccatcctggctaacatgctgaaaccccatctgtaataaaaatacaaaaattagccaggcatggtggcgggcacctgtaatcccagctactcaggaggcttaggcccaagaattacctgaacctgggacgtggaggttgcagtgagccaagatcgcaccactgtaccctagcctgggcaacagagtgactcttaaaaa

SEQ ID NO: 11525 - DNA, 396 bp, Homo sapiens
  misc_feature (34)..(34): n is a, c, g, or t
  misc_feature (43)..(43): n is a, c, g, or t
  misc_feature (65)..(65): n is a, c, g, or t
  misc_feature (84)..(84): n is a, c, g, or t
  misc_feature (104)..(104): n is a, c, g, or t
ggaaatggcagaaatcacctgtccttcctgcggnccgcacgcngggaggctgtataccggagctngttccctattcgggccatncttggctccccaagatatanggaagtttctagcatttgaagagagatgcagaagaacccattcattattgcatccagcacccagaaaagttcctaacacatacaccgagagtggtcagccagatgggcgggaaccagtatgctgtttctgctatccagtacaccttaccaagatttcacagaacctctgactaatacagcaatattgattttatctaaagggaattacttttaagaaaattttctcctaaatcgccctggaagatgctctcttgtttaaccaaatagtgttgattaaaaggttgaaatgaat

SEQ ID NO: 11526 - DNA, 506 bp, Homo sapiens
ctattattctttaactttttaagatataaaatattaatacagtgtagcagagatttaaaatttttaataggtattaccaaactgcttcatagcattggtcttttcagtagctatttgtattttctaaggcaatagcaatatacacagaaaatgggttttctttgtccttactatatcagtgcaatctaatacgtacattagttagtgagattgctttgggaaaaatagaaagaacattgagattctaaaacaggatgtctatgttcaaagtctggctgaatttcacttactacttgttgaacttgtacaacttattttaacctttccttgccttatttttaaaattttgcaaaatggtgttaatattacctatctataagaccctcggccaggtgcagtgcttatgcctgtaatcacagtacttgggagaccaaggagaggattgcttgagctcagaagtttaagaccagtctgacaacatagtgagaacctgtatctcaaaaaaa

SEQ ID NO: 11527 - DNA, 549 bp, Homo sapiens
atggtggatttgtttctgcttaaaattggatcaaaataactaaaaagaaaaatagaagataactaaagattatgattgctttataaattctactgaatgttgttgtttcacctatgaagccacagaatgataatggctataagcatctgaatctgtagtttattgtaaaatattaaccctcatcttttgtagcaaattcagaactattactgttccttcagtgtagaataacagagcttttcaaatatattagaccagtttcaggagtttttcattaaccttttagccttttacaccattatccatataagcagcagaattaactttgtagactattttaatttcgtgataatattatggaatatactttgattctaggattttaaaatcctatatttttgctatctgtatcaattaaaattcttgaaaagatactgtctttattcaccaacataattcttttgtgaaggcaggaggtaagtttctcatattggataatcaagctttgttctaatctaaagaaaaccagtcatttgaaaatgtaattaa

SEQ ID NO: 11528 - DNA, 406 bp, Homo sapiens
ccattctctgttaaactagcaaaatctttcaattagttcatcccatgccatgaacatgctgatgtactgtgttcttacatattcaatgtgtctctttgatcaatgcctttaactaattatgggtgagtggaaactcccttatatcacaccattttgtggcactcctggtgttagagataattatgggtagtggtgccaggagcagtatagctttctcttctatgctaaatctacttctaaatctctcaacctataataattcattatttaggagctgggttaatactgaggaatagcattctttgaatttgcgtttggatggggcaaggctaatcatatcaggatgtggttggtaccaattatggcacttggttttctagactgttaaaagacataacaaaatgat

SEQ ID NO: 11529 - DNA, 449 bp, Homo sapiens
actggaagagtttctgtttggggcaataaaaaatctttggaaatagtggagatggccataaaactttgtgaatattataaatgttattaaattatacagttaaaaatggataaaacggcaagttttatgttatgtatattttaccaaaaaaaaaataaacaactaccacgtgacttatcagccaaacacatacttttctgcaaacacacattatttgtgtactcatttattccttcatcctccttccttaaacagtctgctgcaattcaggcaaatgttttcacacacaaaggtttccttctcagaaacttcactgtcagtgtgaagctgaggcataagaacttgaaggaggaggggagggaagaacttgaaggaaggacctttaatgctaggtagcgttatagcatcttattttttgatagacaaaatagaatgcactaaacaaacac

SEQ ID NO: 11530 - DNA, 676 bp, Homo sapiens
agtctgctttttccccatacagtttttggtggggggggtccatggtccccccttgctggttcctccctcccccctttttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggca

SEQ ID NO: 11531 - DNA, 841 bp, Homo sapiens
gagcgttcaacgatgatgccagtcagagaccattcgacattcagatcatacttagtagaacgagtgacatatagagatagatcgagacagacaaattagtcatcagagttaagtcgaggacggacaagagtagtatactatatgatagaggaacgtgacacttactgcaagtacggagtcgacgagatatacagactagacgtatatagtagagactcacgagatgtcgtcgacacatatatcgtgagcgtaagtgatgttattaagctcatgatctagagactaagatactagtatatatgacttcacagatgcgttagatattcatacgactcgtctagtagaatggtaccagcgagaataaatacgagtaagtaatatatatgtctataagaagatgttacatgaagatgaagaagaacccgcaaataattatagtcacggttgaggataatgaaaccagataagagtgagctggacctagtcaattctaattgaattcagtcacattcgtaaagatgagaccagagagagaatattaaccaggatggtcaatattacaagtgagacaataaagtagactgaggtcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggca

SEQ ID NO: 11532 - DNA, 799 bp, Homo sapiens
  misc_feature (365)..(365): n is a, c, g, or t
gggctaataataataactctataccaatagagtcagtgtagtcagtaagaagatgtcatctaacctaagatggtcaagatgtgctacaatccatacggcgtgcaagctcataaaatgacaaagagcagacggatcggaatgatcatgtaacatagatcaatagtagatatagacgcgaatatagagggtagtagactaagtcagacaagatatagatatacaagatatcaattctagatagtgcgagaagtcagagagtataagcgtgtagaggattcaagcatctaatatagtagcgtactgacaatacatagaagaagactagtgagagagtcgaagtgagagagtctgtaggcaagagtagncatatggtgtatacaggagagctcagatattattatgaatcgaattgacattagaaaatctactatcaatagagtctatctgtataactgatgtatgagatatatataaaagtagtaaggaagatatgaaaatctaagaaatagaatgtaacgacaacagatatatcgaatagcgaagaatcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggca

SEQ ID NO: 11533 - DNA, 490 bp, Homo sapiens
  misc_feature (439)..(439): n is a, c, g, or t
  misc_feature (442)..(442): n is a, c, g, or t
  misc_feature (465)..(465): n is a, c, g, or t
tgatgtatcccaacacagccgtagatgcatgtcggcaataaaagagatgggttcaaagatgaaaataagtaggctgggcgcagtggctcatacctgtaatcccagcactgtgggaagcagaggcaggcgtatcacttgaggtcaggagtttgagaccagcatggccaacatggcaaaaccctgtctctactaaaaatacaaaaattagcaggcatggtgttgggcgataacatcatgttatcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgnttngctcatttacaaaagtgttgtancagtgttggcgctacatccgggacc

SEQ ID NO: 11534 - DNA, 881 bp, Homo sapiens
agtctgctttttccccatacagtttttggtggggggggtccatggtccccccttgctggttcctccctcccccctttttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcaaaagtcagctgtctcacttgttttggagggaaagggccagagtggggctgggagacaggagaggtacctggcccagggaaggagggcgatggggactggaccaaggggtggcaggacggaggcagactttttcctggtgacctttttgtaaagtagatttctttccctccctcccccattcttttattgtggacacgaatgttca

SEQ ID NO: 11535 - DNA, 573 bp, Homo sapiens
gcagctggcgccgtcacaccgtggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcaaaagtcagctgtctcacttgttttggagggaaagggccagagtggggctgggagacaggagaggtacctggcccagggaaggagggcgatggggactggaccaaggggtggcaggacggaggcagactttttcctggtgacctttttgtaaagtagatttctttccctccctcccccattcttttattgtggacacgaatgttca

SEQ ID NO: 11536 - DNA, 797 bp, Homo sapiens
ttccttggttgtgcagaaattttttagtttgatgtaaccccatttgtctatttttgcttttgttgcctgtgcttttgggtttatgtccaaaaaaacattgcctagcctaatatgatggaccttttctctgtgttctcttctagtactttcacagtgtcagatcttacatttaagtctttaatccattttgagttgatttttgtacatggtgttctttattgagtatattatctatttttattctgaaggctcaatgttttgcctgctgtgtatagaaagcaaagaactttaaatcttttttctgaagaaaaacaacctgcttaatgatggaacaaaaaatgtgtccctatcgaacagaaacctgggtaccatgtacttgctatatatactgttaaaaactactccccattcccccttgtacttttagtattatagcttaatcctttatgccccattagtttctataggttatttttctataaaaatttcttgcagatccaatgctattttcatagatgaattagctacttatttattcaacaatcatatgaattctgatatatgccagacactgctcttggtgctagggatacagcaatgaacaaaatagctggtccctaaacttttattcccatgaaggtttcatgctttttcttcttcctttgccagttcatttttgtcctccccaccagcccaggctcagccagtctctagttctccaacatgctttctgaatttagatgtggctactgttctgtgcctacttctgggctgggctaatgagggacctaaagaag

SEQ ID NO: 11537 - DNA, 904 bp, Homo sapiens
atgcccagatatccaataaccttctcactgtggctttccttaccaccctattttaaactgcagtttcccagggaattgcatgagtatccaaagcagagcgaagagccagtgtggtggccctctgtcagggaggctggtatagccaaacagagtgagtgaaggcagactggttagaagtaaggtcagagaggtagcaggaagggagtagaagtggcgagaacttgtagggccttgtgggtcattgccttgtttgcaatcaaatttaagttttccagggcctatgaaaacattgcgagaaagctctggaaagttatagctggttggccagggatctagagcagcgttttggagagaaataacttacagtcacggaaaggaaggccagaggaaggagcagaccaggtctcccccaactcaatagtggtggcgctgccttttcctgctagcactgtagaaacactggatgaggaccactgctgcccaaattcttctctcctccacctaagaattccccaggagagaacgaaacccagtttttgtttttgaaaagaaaattaccagtaattttgttttgttaatttttttgcattgaatattattcttatatatccactaatttttaagaaaatatacgtgtatattcaaaatttggtttcatttttaggcccaacctcaatatcttaaaataggatttagataagaaaaagtaagataaagatacttgcttgagtctggtggttttgtaactgttatttatgtctactttaatttgggggcatataataaagcaaacacattttctttctatgacatcctaaaaaataagacttgactcagtatactctgtgtttctaatgaacataaaagtgtgaatggttttattttgatttgtcttttatcgttg

SEQ ID NO: 11538 - DNA, 383 bp, Homo sapiens
tgagatagcatcttgctctgttgcataggctggggtacagtggtgtggtcttggctcacttcaacctccacctcctgggttcaggctattcttgtgcctcagctactcttagctgggattacaggcgtgcaccactatgcccagctaactttttgtacttttagtagagatagggtttcatcatgtcggccaggcttgccttgaaatcgtgagctcaagtgatccatgatccacccaccttggcctcccaaagtgctgggattacaggcatgcgctaccatgcccggcctaatttgagatattaataggtgccatacagaaaataaaacaggatgatatgatgaagtgtgacaagggaggggagttaatttacataggtatta

SEQ ID NO: 11539 - DNA, 4383 bp, Homo sapiens
gttcactccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgc

SEQ ID NO: 11540 - DNA, 2627 bp, Homo sapiens
gcctttctcttctagctttgggatctcaggaggaggagaacccaagaaactgtggaatgatgtgaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgc

SEQ ID NO: 11541 - DNA, 2536 bp, Homo sapiens
agagttattgtcagggagttcagagtttaatagggaagtcagatacctaaatggatattgtacttagacacacagaaataggattcctagagatgtccaagtattagaagaactgagaggaaaggttcttaactcagcctgcggtgcggggccccctggaggaggtgtcatctcctgtattatatgggcttagtaagtcctgaattgaacagctacacatcaagtcttatggtcactttgaagagaataaagccagagggattcctggtgtgtctccgttcttccctgccagggagttagtggttctgagttggccacggtgagtgtgcaactcaccaaacatccctcttcctccttcctttcactcccttctcagagcatgatggaagcctgcgttttcatttcagactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgc

SEQ ID NO: 11542 - DNA, 1816 bp, Homo sapiens
cagagcctgggcttctgcatttttaaaaagctctgtcagcaattctgtgtgcagttgggattataagccagtaagcatccgaggatggcctcttgctagttgggcctcggggtattgggctttgggtgccctgaccattgttccctgccttaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgc

SEQ ID NO: 11543 - DNA, 413 bp, Homo sapiens
tgagacagagtcttgctctgtcagccaggctggagtgcagtggcacaatcttggcttactgcaacctccacctcccgggctgcagcaattctcctgcctgagcctcctgagtagctgggattacagatgtgtgccaccatgcccagctaatttttgtatttttagtagagacagggtttcaccatgttggccaggctgatctcgaactcctgagatcgggcagattgcttgagcccaggagttcacaaccagcctgggctggtaaaaccccgtgtctattaaaaaaacaaacaaaaaacaaacaataagctagcagagtgtttcctgtttcaggcctgctatgagagaggcgaggaagtcagtgtagtgcccaaaacatctgcttccactgactccccctggatgggtctcgc

SEQ ID NO: 11544 - DNA, 541 bp, Homo sapiens
gcattcttagctgcagagttgcttctgggggaagggaatgcgcacatagcaactgaattctgaaaaggctgcagtgtttaccagagatggcttagaccagtcttctcctttgagaaggttctagttttcgctcctagaacctttctgccttactttaaaagaagggttataaaggagccccagaaggttgcagctaaaggactaacagatgtcatctaatttcagagtctgggctgacctgacccacagcacagacccttgcagtagttgcaggacagcacagtggtgtctgggatcagaatccagaagcgttctgctattggtccctgagttttccatttgggagaggacttagaggtgacagcatttcctttattactgtctacagctgttaccgaggcacaagtggacgatgaaggtggaacgctcattgctcggaaggtgggcgaggccgtgcagaacactctgggagccgtggtgacagccattgacataccactaggtgggcctggcagtgcttctcttgggggtagtggatgcg

SEQ ID NO: 11545 - DNA, 4474 bp, Homo sapiens
gttcactccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgctgattttaaatgctttcttgattgaggaaggtatgttaaataaagagtagattttcccagtagcctaatactcaacacatgggattttacc

SEQ ID NO: 11546 - DNA, 4285 bp, Homo sapiens
gttcactccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgc

SEQ ID NO: 11547 - DNA, 333 bp, Homo sapiens
aatgtcactcactacccatgtgcctgtgtttctgcttgtatagatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggtcagttggcttgtgccccaagggcttctcattggggtgccagtgggtggtgagaacactcagttcgccagcttt

SEQ ID NO: 11548 - DNA, 326 bp, Homo sapiens
atttccgctgcacaacacgccgtgctttagcggaagatgaccgtttccactgcacaacactacaagtgtttactgccaggccggtgtgaaatatgttccagcacataatctatgtcaccaatgaaggtggtggttcagacttggtgcacgcaagctttcctgtcccacaagaacacagcatgctctcttctcgggttccattccaatcacataacaaacatgactgccttttttgtctcggcatcagaaagatcagaggaaaatttgcactcaacttagacaactctaagctcttataacctgcctatatctacaggtcagcttta

SEQ ID NO: 11549 - DNA, 3240 bp, Homo sapiens
agcggacatttaaactgctgcctgcctgtgcagcagctgaggaaccgtggatttcatattatagactaaaaccccattaaaactgctcaaaatccttcctgcagctgccaggcaacaacgaaagaagagaggtaaatcctattcttttccaatacaactgaagcactacattttagctctggctgctttacattgcagctcagtgttattagtagaaatatggatactgagacgagaacacagcactgcattgtccagccaggaaaatagcagatgtaaaaagcttcaatgcatcaactgtcgggaagagtcaacagtgctacaagcagaacgggcaactacagctcttttgtttaacgaaagagagaaaatgaaagaaagggaaaatttcagaagactaggacccatatgaacaaggagggtaactcgaagacaagcagacagatggacactttggatactgtgaaaagcaatcgcaggaggcagactgttgggggatgtgcgcatgttcgatagcatcttttttgctgaagtgatggcgtgccaaaagtattttcagtgggcataatcctcttcacataaatggcctgaccaaggaagaatgactacaagagagacaatgtgactgaattagaaaatgattgccaaagaatagtattaaggagaagaaaacatttttggtcaccaatctctcatataccactactggatatttacaacatgcttcagtggaggagaagacactgctgctttgcaaagatgacctggaatgccaaaaggtctctgttccgcactcatcttattggagtactttctctagtgtttctttttgctatgtttttgtttttcaatcatcatgactggctgccaggcagagctggattcaaagaaaaccctgtgacatacactttccgaggatttcggtcaacaaaaagtgagacaaaccacagctcccttcggaacatttggaaagaaacagtccctcaaaccctgaggcctcaaacagcaactaactctaataacacagacctgtcaccacaaggagttacaggcctggagaatacacttagtgccaatggaagtatttacaatgaaaaaggtactggacatccaaattcttaccatttcaaatatattattaatgagcctgaaaaatgccaagagaaaagtccttttttaatactactaatagctgcagagcctggacaaatagaagctagaagagctattcggcaaacttggggcaatgaaagtctagcacctggtattcaaatcacaagaatatttttgttgggcttaagtattaagctaaatggctaccttcaacgtgcaatactggaagaaagcagacaatatcatgatataattcaacaggaatacttagatacgtactataatttgaccattaaaacactaatgggcatgaactgggttgcaacatactgtccacatattccatatgttatgaaaactgacagtgacatgtttgtcaacactgaatatttaatcaataagttactgaagccagatctgcctcccagacataactatttcactggttacctaatgcgaggatatgcacccaatcgaaacaaagatagcaagtggtacatgccaccagacctctacccaagtgagcgttatcctgtcttctgttctggaactggttatgttttttctggagatctggcagaaaagatttttaaagtttctttaggtatccgccgtttgcacttggaagatgtatatgtagggatctgtcttgccaagttgagaattgatcctgtaccccctcccaatgagtttgtgttcaatcactggcgagtctcttattcgagctgtaaatacagccacctaattacctctcatcagttccagcctagtgaactgataaaatactggaaccatttacaacaaaataagcacaatgcctgtgccaacgcagcaaaagaaaaggcaggcaggtatcgccaccgtaaactacattagaaaagacaattttttttcaaatgtgcaatttgtaaatattgctaaaagcatgtatagttaggaactgattacatccgtaggacaagttttagttaaaactcatcacataaagaaattcaagaagtatttttttaatttctgaagaagttaattcttaaaactataacattatataacaaaaaaggtttcccaaaacaatctatttaaaaaactgtataaggagattctgtgtattaacatgcaataacaagcatgcataaatcaatggttcaagtcttctgttagggggccaataaaatgtatctgcatatgttttccacataaattttaattcaagaaatgacagtcaaaagatccttcattttagattaagcttttcattttaatatataatttaatgtaaataaaacatcactatcaattttaaggaaactttttaattgtgcaaaggataaattttttgacctattttagggttctaaatgcaataagatttagttgagttattccacaaacacattataaagttcagatgtttcatcaatgcagttctcacgaaagtatttactttttaaaaataactgagatattattttaaatttcttttattaatactttcttttattaatatatgggggaaaattattttgacatgacgtggtaaaatgtgaaaaactaatgtgtctcaggctcaagtttttatagttattaaatgtttcaaaatagacaagttttgtttcctcattgatgttaagaaccaaactcctatttcaatgagttattggattagaccaattactgcactcttaaacagcaccaccatttaatttcatgtatatctaacttcgaatatatctgtaaagataatcgaagcaaaagtaatcacttaaaggcacaaataggatgtactgttgaaaaagataaagagtgcaggtgcagtttcattcaacacatttttaagatgcatgtctgccaaaatgcaacatacgggaagtttatttcctgacagcaggtgtacacatgccaacacttaatcattttatggcacctatttctttcttggagtgccaagtttgcaaacctgcagtttttaatttggtagatgacaaatattctgaatcaccaattaaaaacctttttgggagggatggggaaaactacaaacgtttgacaaacacaattctaggatgaacaatgtatacaatgcacttttatgaagtttttaaaaataaaggaaaacaaaaaacttta

SEQ ID NO: 11550 - DNA, 3409 bp, Homo sapiens
cggcaaaaagacaacatacttagaaataaagttaaataaggaggtaaaagactcgtacactgaaaactataaaacattggtgaaagaaattaaagaaatgaataagtgaaagatggcccatgttcatggattagaagaactaatattgttaaagtgtccatactacccaaaatgatctacaaattagatgcaatccctatcaaaactccaatggcatatttacagggttagaaaaaacaattataaaattcacatgaacccacaaaagagctcaaatggccaaatcaattgtgagaaaaaaagaacaaagctggaggcatcacagttcttaatttcaaaatatattagaaagctatggcaatgagaacagtatgctactggcataaaaatagacatgtggaccgatggatcagaagagagaccccagtaggaaatttgcacatatacagtgatctgatctgcaacaagggtgccaagaatcaacagtgctacaagcagaacgggcaactacagctcttttgtttaacgaaagagagaaaatgaaagaaagggaaaatttcagaagactaggacccatatgaacaaggagggtaactcgaagacaagcagacagatggacactttggatactgtgaaaagcaatcgcaggaggcagactgttgggggatgtgcgcatgttcgatagcatcttttttgctgaagtgatggcgtgccaaaagtattttcagtgggcataatcctcttcacataaatggcctgaccaaggaagaatgactacaagagagacaatgtgactgaattagaaaatgattgccaaagaatagtattaaggagaagaaaacatttttggtcaccaatctctcatataccactactggatatttacaacatgcttcagtggaggagaagacactgctgctttgcaaagatgacctggaatgccaaaaggtctctgttccgcactcatcttattggagtactttctctagtgtttctttttgctatgtttttgtttttcaatcatcatgactggctgccaggcagagctggattcaaagaaaaccctgtgacatacactttccgaggatttcggtcaacaaaaagtgagacaaaccacagctcccttcggaacatttggaaagaaacagtccctcaaaccctgaggcctcaaacagcaactaactctaataacacagacctgtcaccacaaggagttacaggcctggagaatacacttagtgccaatggaagtatttacaatgaaaaaggtactggacatccaaattcttaccatttcaaatatattattaatgagcctgaaaaatgccaagagaaaagtccttttttaatactactaatagctgcagagcctggacaaatagaagctagaagagctattcggcaaacttggggcaatgaaagtctagcacctggtattcaaatcacaagaatatttttgttgggcttaagtattaagctaaatggctaccttcaacgtgcaatactggaagaaagcagacaatatcatgatataattcaacaggaatacttagatacgtactataatttgaccattaaaacactaatgggcatgaactgggttgcaacatactgtccacatattccatatgttatgaaaactgacagtgacatgtttgtcaacactgaatatttaatcaataagttactgaagccagatctgcctcccagacataactatttcactggttacctaatgcgaggatatgcacccaatcgaaacaaagatagcaagtggtacatgccaccagacctctacccaagtgagcgttatcctgtcttctgttctggaactggttatgttttttctggagatctggcagaaaagatttttaaagtttctttaggtatccgccgtttgcacttggaagatgtatatgtagggatctgtcttgccaagttgagaattgatcctgtaccccctcccaatgagtttgtgttcaatcactggcgagtctcttattcgagctgtaaatacagccacctaattacctctcatcagttccagcctagtgaactgataaaatactggaaccatttacaacaaaataagcacaatgcctgtgccaacgcagcaaaagaaaaggcaggcaggtatcgccaccgtaaactacattagaaaagacaattttttttcaaatgtgcaatttgtaaatattgctaaaagcatgtatagttaggaactgattacatccgtaggacaagttttagttaaaactcatcacataaagaaattcaagaagtatttttttaatttctgaagaagttaattcttaaaactataacattatataacaaaaaaggtttcccaaaacaatctatttaaaaaactgtataaggagattctgtgtattaacatgcaataacaagcatgcataaatcaatggttcaagtcttctgttagggggccaataaaatgtatctgcatatgttttccacataaattttaattcaagaaatgacagtcaaaagatccttcattttagattaagcttttcattttaatatataatttaatgtaaataaaacatcactatcaattttaaggaaactttttaattgtgcaaaggataaattttttgacctattttagggttctaaatgcaataagatttagttgagttattccacaaacacattataaagttcagatgtttcatcaatgcagttctcacgaaagtatttactttttaaaaataactgagatattattttaaatttcttttattaatactttcttttattaatatatgggggaaaattattttgacatgacgtggtaaaatgtgaaaaactaatgtgtctcaggctcaagtttttatagttattaaatgtttcaaaatagacaagttttgtttcctcattgatgttaagaaccaaactcctatttcaatgagttattggattagaccaattactgcactcttaaacagcaccaccatttaatttcatgtatatctaacttcgaatatatctgtaaagataatcgaagcaaaagtaatcacttaaaggcacaaataggatgtactgttgaaaaagataaagagtgcaggtgcagtttcattcaacacatttttaagatgcatgtctgccaaaatgcaacatacgggaagtttatttcctgacagcaggtgtacacatgccaacacttaatcattttatggcacctatttctttcttggagtgccaagtttgcaaacctgcagtttttaatttggtagatgacaaatattctgaatcaccaattaaaaacctttttgggagggatggggaaaactacaaacgtttgacaaacacaattctaggatgaacaatgtatacaatgcacttttatgaagtttttaaaaataaaggaaaacaaaaaacttta

SEQ ID NO: 11551 - DNA, 3756 bp, Homo sapiens
cggcaaaaagacaacatacttagaaataaagttaaataaggaggtaaaagactcgtacactgaaaactataaaacattggtgaaagaaattaaagaaatgaataagtgaaagatggcccatgttcatggattagaagaactaatattgttaaagtgtccatactacccaaaatgatctacaaattagatgcaatccctatcaaaactccaatggcatatttacagggttagaaaaaacaattataaaattcacatgaacccacaaaagagctcaaatggccaaatcaattgtgagaaaaaaagaacaaagctggaggcatcacagttcttaatttcaaaatatattagaaagctatggcaatgagaacagtatgctactggcataaaaatagacatgtggaccgatggatcagaagagagaccccagtaggaaatttgcacatatacagtgatctgatctgcaacaagggtgccaagaatcaacagtgctacaagcagaacgggcaactacagctcttttgtttaacgaaagagagaaaatgaaagaaagggaaaatttcagaagactaggacccatatgaacaaggagggtaactcgaagacaagcagacagatggacactttggatactgtgaaaagcaatcgcaggaggcagactgttgggggatgtgcgcatgttcgatagcatcttttttgctgaagtgatggcgtgccaaaagtattttcagtgggcataatcctcttcacataaatggcctgaccaaggaagaatgactacaagagagacaatgtgactgaattagaaaatgattgccaaagaatagtattaaggagaagaaaacatttttggtcaccaatctctcatataccactactggatatttacaacatgcttcagtggaggagaagacactgctgctttgcaaagatgacctggaatgccaaaaggtctctgttccgcactcatcttattggagtactttctctagtgtttctttttgctatgtttttgtttttcaatcatcatgactggctgccaggcagagctggattcaaagaaaaccctgtgacatacactttccgaggatttcggtcaacaaaaagtgagacaaaccacagctcccttcggaacatttggaaagaaacagtccctcaaaccctgaggcctcaaacagcaactaactctaataacacagacctgtcaccacaaggagttacaggcctggagaatacacttagtgccaatggaagtatttacaatgaaaaaggtactggacatccaaattcttaccatttcaaatatattattaatgagcctgaaaaatgccaagagaaaagtccttttttaatactactaatagctgcagagcctggacaaatagaagctagaagagctattcggcaaacttggggcaatgaaagtctagcacctggtattcaaatcacaagaatatttttgttgggcttaagtattaagctaaatggctaccttcaacgtgcaatactggaagaaagcagacaatatcatgatataattcaacaggaatacttagatacgtactataatttgaccattaaaacactaatgggcatgaactgggttgcaacatactgtccacatattccatatgttatgaaaactgacagtgacatgtttgtcaacactgaatatttaatcaataagttactgaagccagatctgcctcccagacataactatttcactggttacctaatgcgaggatatgcacccaatcgaaacaaagatagcaagtggtacatgccaccagacctctacccaagtgagcgttatcctgtcttctgttctggaactggttatgttttttctggagatctggcagaaaagatttttaaagtttctttaggtatccgccgtttgcacttggaagatgtatatgtagggatctgtcttgccaagttgagaattgatcctgtaccccctcccaatgagtttgtgttcaatcactggcgagtctcttattcgagctgtaaatacagccacctaattacctctcatcagttccagcctagtgaactgataaaatactggaaccatttacaacaaaataagcacaatgcctgtgccaacgcagcaaaagaaaaggcaggcaggtatcgccaccgtaaactacattagaaaagacaattttttttcaaatgtgcaatttgtaaatattgctaaaagcatgtatagttaggaactgattacatccgtaggacaagttttagttaaaactcatcacataaagaaattcaagaagtatttttttaatttctgaagaagttaattcttaaaactataacattatataacaaaaaaggtttcccaaaacaatctatttaaaaaactgtataaggagattctgtgtattaacatgcaataacaagcatgcataaatcaatggttcaagtcttctgttagggggccaataaaatgtatctgcatatgttttccacataaattttaattcaagaaatgacagtcaaaagatccttcattttagattaagcttttcattttaatatataatttaatgtaaataaaacatcactatcaattttaaggaaactttttaattgtgcaaaggataaattttttgacctattttagggttctaaatgcaataagatttagttgagttattccacaaacacattataaagttcagatgtttcatcaatgcagttctcacgaaagtatttactttttaaaaataactgagatattattttaaatttcttttattaatactttcttttattaatatatgggggaaaattattttgacatgacgtggtaaaatgtgaaaaactaatgtgtctcaggctcaagtttttatagttattaaatgtttcaaaatagacaagttttgtttcctcattgatgttaagaaccaaactcctatttcaatgagttattggattagaccaattactgcactcttaaacagcaccaccatttaatttcatgtatatctaacttcgaatatatctgtaaagataatcgaagcaaaagtaatcacttaaaggcacaaataggatgtactgttgaaaaagataaagagtgcaggtgcagtttcattcaacacatttttaagatgcatgtctgccaaaatgcaacatacgggaagtttatttcctgacagcaggtgtacacatgccaacacttaatcattttatggcacctatttctttcttggagtgccaagtttgcaaacctgcagtttttaatttggtagatgacaaatattctgaatcaccaattaaaaacctttttgggagggatggggaaaactacaaacgtttgacaaacacaattctaggatgaacaatgtatacaatgcacttttatgaagtttttaaaaataaaggaaaacaaaaaactttactgagtgttataagtattttcacaataattttgtttgactccatcatgaattttaaaatcaagaaataccaacctactaactaaaatagtgtttttattccatacaagtatgtaaatctgtcaatcttaatttagtcagaatgtttcttaattctaataacaatcatttttacctcttattctattattaagggataaatcaccagaagagaattgtaacatttgtgaaacttgaaaacactaaaactgtttaagtgcttatctccatttcaaatcagtagcctaagtgttctactctaaatcaagtgattctgagagctgatctatgtaacacaccccagctcttg

SEQ ID NO: 11552 - DNA, 994 bp, Homo sapiens
gtagagaaagtgtctgtgttgcccaggctggtctcaaactcctggccccaagagatcctcctgccctggcctcccaaagtgctgaaattataggcatgagccactattcccagccatctttttctaactttcattacttctgtcatagatcaacctgtaatacatacctgggagtcttttaaaggctaaacctttactattgtgttgaacccatcatcatctacaaaggattatctgctaaaaaactgaactggtatgaggtcagttttctagaccagaggtcacattcatacatgttttaagcttggccggcaatatggtgtctgtcctcgacaactcaactctgcattgaagcgcaatagcagccataaacagtaggtaaatgaatggccaaggtatgttccaacggaagtttacttacaaacatgtggagacttacatttggtcctcaggctgcagagtgccatatgtcctctagacatattcacgtgtaacaaaataacaaaaataaaggaaagtagacaagatcaaacaatactccagagatgcaatcatcaaaatttcaccaggggaaactctggaaatacaagtccacatttttcaacaaataaattgaaaagaaaaagagggccaggcatggtagctcacggctgtgatcccaaactgctgagatcacaagcgtgaggcaccacgctaagcctaatttagtgactaagagatatcttaaatatatataaaccttgtgtggataaacagaaaaaaggaaaacattcggtgatatttgaatactgattgtatactggatattgaattactggtagtattttgagatataacaatggaaatgtggttatattaaaagacttattactagctccatattgcttttgatttgggattttcgtctctatgtttacaagtgatttaggcctataattttcctctttggtactgttaatgtctggttttggtatcaaaataaataagcctcata

SEQ ID NO: 11553 - DNA, 458 bp, Homo sapiens
gtttaaaacgttcttcacagtatagctatacccaccttcacaggcttatctgtcagttcctctctactggtgccattcacctcatttgctgggtcttgaagaagccctagcatttcttgacaccaagcatttacatatgctgttcccactataccttggctatctaactgatgaactcctatgtggtttgaaggagccttttcaaagatcaccttctttgtaaaggttttcttaatgcccaattattttactccctgagattatactcctgtgttcttcatcaagcctttacaaactatattaaatttcttggacatttctcagtgttgcctgtaagattatgaacctgttaaattcagagacatctttcatccctgtattctcatatttgatatagaaatccgacacttaccatgagccctttaaatgtttattaaaagcaaaaataactaaaaatg

SEQ ID NO: 11554 - DNA, 371 bp, Homo sapiens
gccactgcactccagcctgtgtaacaggatgagactctgtctcaaaaaaaaaaaaaaccacctccgccccacataaaaaaacacttataggatttaaatcacaaaggaaaaaaatagaatagatactagtcgaactactcttttaaatagcttttttgaggtataattcacatgacataaaattttgcccattttaagtgtacaattgaataaatttgtaaagttatttaccattacagtcaagttttcagatatttgaaaagcttgtccctgagtgtttacagtcaatttacactcccatctgcaaccggagggtcaagtttctgtgcctatagttttgtgttttctagagtattatataaaaggaatcc

SEQ ID NO: 11555 - DNA, 1153 bp, Homo sapiens
ttagcagtgatccccatccttcggccacgctcacgcctgtaatccctatacttgggaggccgaggcaggcggaacacgaggtcaggagttagagaccagcctggccaatatggtgaaaccccgtttctactaaaaatacaaaaactactgggactgcaggcaagcaccaccatgcctggctaataaattttttttaagctctggggagagagagatttatgctgggtgtcttaaaggcttgggagtgtgttttctcatttgatttactcatttgctcttcagcgatttcgtagttacatttctttaaatcctaagttacaaaagtttgtctcataatttacataaaagctcttaatttcggacctatcttggagaaggctgggatttttaggaccttcccccacttaagattttccgcttaactaaccttgccagagggtgctacttcgcattttctttttgaatcattgtcgttcgaccgattaaaaatagagaaaaagtaaaatgttttatttattttagagatgttggaagttgttgtttttcctgtctaatgtcttgtatataattaggaagttgtccagaaacttgcgtctctgattttggtaaaaatcttcctgtcattcagctgtgtaggaacgaatctccaaaataaaattgtccatctttagcctgcaaaacaaattgtcgtagtgaacatatgctatattgttaattgctataacttgagtatctgatggtgggtggcctttgttcagtattgatttcctgtgcactgtaacctggcaactggatttttaatttttcttcctgtgttcagttagactttaactagaaggcagtagaaactggaagtgaaaaatttcttgagtgcaagccagtgttttattgctaaattaagattctcctgactaattggattttctcggtttaaaaatctacaagctatcatttttgggtcttgtggttagcgattgtctcttttcaggggaaaaaaaacctttgtaaatatcaactgttcagaaccaatctcgctgttaaacacctaagatcatatttacgtgagctcaaaaaatactctagtgagccgagatcacaccactgcactccagcctgggcgacagagcaagactctgtctccaaaaaaaaaaaa

SEQ ID NO: 11556 - DNA, 747 bp, Homo sapiens
cgctggaccagaaggtgtaaacgacccagagggtgctacttcgcattttctttttgaatcattgtcgttcgaccgattaaaaatagagaaaaagtaaaatgttttatttattttagagatgttggaagttgttgtttttcctgtctaatgtcttgtatataattaggaagttgtccagaaacttgcgtctctgattttggtaaaaatcttcctgtcattcagctgtgtaggaacgaatctccaaaataaaattgtccatctttagcctgcaaaacaaattgtcgtagtgaacatatgctatattgttaattgctataacttgagtatctgatggtgggtggcctttgttcagtattgatttcctgtgcactgtaacctggcaactggatttttaatttttcttcctgtgttcagttagactttaactagaaggcagtagaaactggaagtgaaaaatttcttgagtgcaagccagtgttttattgctaaattaagattctcctgactaattggattttctcggtttaaaaatctacaagctatcatttttgggtcttgtggttagcgattgtctcttttcaggggaaaaaaaacctttgtaaatatcaactgttcagaaccaatctcgctgttaaacacctaagatcatatttacgtgagctcaaaaaatactctagtgagccgagatcacaccactgcactccagcctgggcgacagagcaagactctgtctccaaaaaaaaaaaa

SEQ ID NO: 11557 - DNA, 419 bp, Homo sapiens
agtatctgatggtgggtggcctttgttcagtattgatttcctgtgcactgtaacctggcaactggatttttaatttttcttcctgtgttcagttagactttaactagaaggcagtagaaactggaagtgaaaaatttcttgagtgcaagccagtgttttattgctaaattaagattctcctgactaattggattttctcggtttaaaaatctacaagctatcatttttgggtcttgtggttagcgattgtctcttttcaggggaaaaaaaacctttgtaaatatcaactgttcagaaccaatctcgctgttaaacacctaagatcatatttacgtgagctcaaaaaatactctagtgagcatattttgctatggaaatagtgtattgaactttttactatttactgtgtggatcggcaa

SEQ ID NO: 11558 - DNA, 348 bp, Homo sapiens
gtgcagctgcaacctctacctcccgggctcaagcgatcctccttgcctcagtctcccgagtagctgggactgcaggcaagcaccaccatgcctggctaataaattttttttaagctctggggagagagagatttatgctgggtgtcttaaaggcttgggagtgtgttttctcatttgatttactcatttgctcttcagcgatttcgtagttacatttctttaaatcctaagttacaaaagtttgtctcataatttacataaaagctcttaatttcggacctatcttggagaaggctgggatttttaggaccttcccccacttaagattttccgcttaactaaccttgc

SEQ ID NO: 11559 - DNA, 229 bp, Homo sapiens
gtatttcactttttagccattcaaatatttattaattaccctgagaactacctccctttgctctcccctaccccctggcgaatgcaaaaggaagaaacagaattactttgaaagagaaattctaggtagaaagtatgagaaaagagcagaaaccaggaaagtgagagaagaagctagaagaaaggaaagaaaaaaaaaagtcgacgcggccgcgaatttagtagtagta

SEQ ID NO: 11560 - DNA, 515 bp, Homo sapiens
gtaaaaatcatagttagggttaagtccaagcagtgaggcctgacctgggctctgctctccttgttgagacactaacaggcagttgggaggaaaatctgcatttgactccaccctctttggggcaaaggagaagcaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgccttta

SEQ ID NO: 11561 - DNA, 554 bp, Homo sapiens
gtaaaaatcatagttagggttaagtccaagcagtgaggcctgacctgggctctgctctccttgttgagacactaacaggcagttgggaggaaaatctgcatttgactccaccctctttggggcaaaggagaagcaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgcctttaaaaaaaaaagtcgacgcggccgcgaatttagtagtagta

SEQ ID NO: 11562 - DNA, 336 bp, Homo sapiens
gaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgcctttacaatgtgttttggtctgaactaagttgagaaacctttccctttctacatgttctccctggggtgggattgggggcagactggctcggagcagaggtggatgagggccagaccccaaaccacaaattacaaatctatag

SEQ ID NO: 11563 - DNA, 287 bp, Homo sapiens
ggcagagttgctctgggattgtgtatgacatattatgaaaccgataatcattggcaaagtaaagcattgctgtttacttcagtgggggctttttgacactatacaaaggaaggtgaaaataatgataccatgaattaattattagccacaatcaagatccatgcatctaaaaatacagtgtcccttttaagtccgagttcccagcaagagtctagagctgacttcaatcacttaggcttcataagaatcaactttttactcttaataaagaaatctccgtacagtcc

SEQ ID NO: 11564 - DNA, 425 bp, Homo sapiens
ccccaccttggcctcccaaagtactgggattacaggtctgagccaccgtgcctggcccacactctgactttttaagtgtaaggaaaacgcttttttacagaagactactaactaagtagtgtagaataattataaaagtagaaaaatccttgtctgggcatggtggctcacacctgtaatcccagcactttggtaggccaaggttacctgaggttaggagttcaagatcagcctggccaacatggtaaaacaccatttctacaaaaatacaaaaattagccaggcgtgatggtgggtgcctgtaatcccagctacttgggaggcggaggtgggagaatcacttgaacccgggaggtggaggttgtagtgagccgagatcacatcactgcactccggcgtgggcgacaaagcaagacaccatctca

SEQ ID NO: 11565 - DNA, 900 bp, Homo sapiens
  misc_feature (744)..(744): n is a, c, g, or t
aattactgcaaaccaggtggcttgaaacaacagaaatgtgttctctcactgttctggaggccagaagtctgaaatcaaggtgtcagcagggttggttcctgctggagactcaggggagaaaccgccggtgccatccccgccagcttttggtgcctgctggtctccctggccttccttggcttgtggctgcattgctccagtctctgcctctgtctgcacatggccttctctgggtctctgtgtgtatctttttctgttgcttacgaggatgcacttattgggtttagacctaatccagggtgatctcatctccattcttaccttaattatatatgtgaagaccctggttccaaataaggtacgttctgaggttgtgggtggatgtgaagtttgcagggaggaggagtcgggtagggggtactatgtgtaacccactacacttcctcaactgcatttgttggcttcccttcctgtctgctcctcagttcccaaatgcattgggatctttctctgacattttggcttttgcacactgtcacctctgcccagagcatctcaaacttgactgtatgttagaattacccgggagttgtattaaaaaatactgatgcccagccaagctcggtggctcacgtctataatctcagtgctttgagaggctaaggccggacgatcgcttgagctcaggagttggagaccagcctgactaacatggtgaaaacccatctctacaaaaacaattangccaggcatgctggtgcatgcctgtagtctcagctacttgggggcctgaggtgggcagattgcttggacccaggaggttgaggctgcagtgagccaagattgcaccactgcactccagcttgggtgacaaagttagatgccatttcaggaaaaaaa

SEQ ID NO: 11566 - DNA, 561 bp, Homo sapiens
attagaactggttgcacacacatacaaacttcctgtgatgaatttaagaacagatcattacagggttagaatagtgacagattcaacaaaggatctgtttgatagggcaccaagggaacattttactggttcccacaaaaattaataaatgttaaatatcatgtcccaagcaatttcccatgtttttttattggtcctaatcaacagaatgttttgtgttccttccacttcacgttcagagcccacgtcatgccacttcctaaaagaccattagaccatccccttttcctccatcctccactgtagccttagccagagaaaagatccagctcacttctggtccaaaaaatgtcaacgtttggaaaatggctcatctacactacagaacacagccagatgacactgctaaagggtactgtaagaaaacacaaggtccaaagtatgctgaattggtttcataagtctaactcattggccagtgactgaaaaaccaggatatcaggattttctgggggccaatagccatgacccttgagctttcatagttcatgaaccactttg

SEQ ID NO: 11567 - DNA, 455 bp, Homo sapiens
tctactaaaaatacaaaaactagccagccgtggtggctcacacctgtagtcccagctactccgaatgctgaagcacaagaatcgcttgaatccgggaggcggaggttgcagtgagccaagatcgcactactgcactccagcctgggtgactgagacactgtctcaaaaaaataaaaataaaaataaaaataaaatattaaaaagaaaatgcagaaaatgcaaagatttctaggagggatacccagaccaatatctgcacttcaaatcttagaagttaaacatttatcaagacatgattctgtacaccctccattcaagccaccagaaatctgagacagaatctcatgtgtctgagactcgaccactctgattttgaagtgaaattatttcaaatgcttaaatgggtagcactgagtgtttgtctgttatttttccaagcccagcacctattcccc

SEQ ID NO: 11568 - DNA, 449 bp, Homo sapiens
ggagctgaagaaaacgacctccctccctcctccccgctgggattccccgggctgagagcgtgagtgagaagcgcaaggcagtttctatcatgggatgactctccgctgggaacttcagggaaaccacaaccatcattactcaggccagacagctgccagaaaagcagcctagcctaagaactgaagctgaaatagaggtgggaggctgtattccattactaagcgcgggagcactcactcccaagtttgtccacatttcaagaatgttaaaaccctgtggtagaaatccctgattatttataacttaaactaccgtgtaaaagcagaaacttgacaaatgaagacataaaaagaactggtgacaggtaggctagtactagaatacaaagcattcatcacactcctcttttgtgggtccttccaaacctccatccccattccctactgga

SEQ ID NO: 11569 - DNA, 122 bp, Homo sapiens
attaatagaacgctagctagattaacaaagaagagatatccaaataagcacaatcagacagaacaaaagtgacattataactaatcccacagaaatacaaaagattctcagagactaatatg

SEQ ID NO: 11570 - DNA, 442 bp, Homo sapiens
gaactaattttccaaactgaaaacagttgtgaaaggcattctattttagcctttttttgtgaagtgggataagttcatgcttcccatctgtttcagttacattgagtgtggtagaattgaactttgtagagaagggaaacaggttggccaaattagtgacagcctcccagtcttctgctttgcatgacactcactctgaagatatctatttgcctagtcttatctacctctcaaatttaggcaagaatttggctcagaaatacaagactactaattactactaaactcttagtaatgcaatgtgtggatttggcccctcactatgtaactgagaagacaacattatggtatattgattccaatgagggttttctttgtcatttttctcctctctggaggtcatctgggtttttgatatggtgataatgactagcaagtgatt

SEQ ID NO: 11571 - DNA, 484 bp, Homo sapiens
tgtcatttgcaacaacatggatgaaaatgggggtcattaagtgaaataagccaggcacagaaagacaaacttcacatgttcttaacttacttgtgggagctaaaaatttagaacaactgaattcatggagacagatagtgtaatgatggttaccagaggctggaaagggtaataacagggagtaggggaaaagtggggatagttaatgggtacaaaaacaatagaaagaatgaataagacctagtatgtattagcacaacagagtgactatagtaaaaaataatttaattgtacattttaaaataactaaaagagtgtaattatttgtaacacaaaaggtaaatacttgaggggacagatacccattcaccctgatgtgattattatgcattgtaagcctgtatcaaaatatctcatggaacctataactatatacatctactatgtaccccattaaaaataaaacattaaaaaaataaatttt

SEQ ID NO: 11572 - DNA, 431 bp, Homo sapiens
catgctcactcacatccatcagtttctttggctacaggatcaacagacatattggggaagtagggcccttaaaagtagaaatagactccaccattccccctccatggactatcccagtttccttcaaaatctgaagcaagtgaaggtctcagatctgtttattattcaaggattccttgacaaaaggttccgcatccctatttgcagttcctgtaacgcctttgttttccatgtacaacacctaagattagacactgctataagaaaatgaaatggctgagtgtagtgtgatgagtcacccaccagattacttaaggatctatgtctgctgcctgaaccctgaaagctaggcagtgagtcagtggcccacccaaggagcaggtatccctgagaaccgaaacatcccagagtatatctgagagcataccaag

SEQ ID NO: 11573 - DNA, 346 bp, Homo sapiens
ctccagtatccaggatcccccaaaggaaatgaaagtaaaaaatctttaggttgaaaagtaattccagcttttagccttatctaccaggttgtctaacagtgagctgtctgagcacgcttgtgtgtgtagtgtcttctttctgcagcctagtgccacctcttgtcagaaaagtgatgttgaaaatagccaaccttttcaaacattgtggacaatatgaaagcacaatgcactctgattggaaggcactaactgtgattaggggcagacctcacagttccccatgaaccttaggcaattgcatcacgtggatatttaccatgttaaatcctgattttgaattaagatt

SEQ ID NO: 11574 - DNA, 2774 bp, Homo sapiens
  misc_feature (997)..(997): n is a, c, g, or t
  misc_feature (1142)..(1142): n is a, c, g, or t
tattttttatattagctttaggttcacagcaaaatagaacataaattacagagggttcccccgcacccctgggctcagcatccccacaagagcggccatttgttatagtcgcgaccgccctggagacagtgtcatcatcacccacaggccgcacgacctcagggtccaccgggtgctgtgcagtctatggttggatgaacgtatcctgatgtggacccaccgttgtggtatcatacagagtagtttcactgccccaggtcccccgtgttcctgctgcacatccctccgtccctccctctccccagcccctggcattcgctgatctttgtgctgtctgcacggttttgccctttcctggatgtcagagtcggaaccgtacagcgtgtagtccttggagacgggctgctttcactcagcagcatgcgtctatggtccttttttgtcttttcagggcctggtaatattctgttgtctggatggacgccgggtgtttaatccactcacctatgagtgtcttgggtcacttgtagttgtctctctgggcttctcttacggataaatgaagaataaacaaagccagccactggcccctgaactcggttctgcctctgacttgtcttgatgaggaggtgtccttgcgtggactcgtgctgtgtcatcatgctcctgctccgtgttcggagccacctgggctgtgacaggaggtcagtgttcagggatgatgcagtttctgttgaggcaacactgaaaatgccttgcttggaaactgcgtctcacagagcatggagcttgttaacaattttaaaaaactgatgatgctgatgggagagagggatgatgggagtctgtctggggtctttgaggccttgtccagagactgccccaggatcctgggtggctgtgcacagccagctgagccatgtgcctgccactgcatctgtactcctgggccagaaagcacctttgcttagcccacctgatttttctgtcagagacnagacgagtaatttctaacctgggcttgagacactaacagtgtattgggatttttttttttggacacacaatctctctctgtcactgaggctggagtgcagtggcacagtcatatagctcactgcagcctcaacctcccgggctcnaaccttcctcctgcctcagccccctgagtatctgaaaccacaggcaggtgccaacacacccagctatttttgtttttttattgttttgttaaaaaaaaattttttttaagagatggggtctccctgtgttgcccaggctggtctcacactcctgggctcaagcagtcctcatgtcagccttccagagtgctgaggttacaggtaatcttcagctgtttcacagtgtccctcttgtcagcctcccagagtgctgagatcacaggtaatcttcatctgtttcacagcgtccctcatgtcagcctcctagagtgctgaggtcacaggtagtcttcagctgtttcacagtgtccctcatgtcagcctcccagagtgctgaggtcacaggtaatcttcacctgtttcacagtgtccctcatgtcagcctcccagagtgctgaggtcacaggtaatcttcagctgtttcacagtgtccctcatgtcagcctcccagagtgctgaggtcacaggtagtcttcagctgtttcacagtgtccctcttgtcagcctcccagagcgctgaggttacaggtaatcttcagctgtttcacagcgtcaccagattctccaaacacaatttaattttattcacatagacagtgctacattgtcactggtgacaggcgctttgtggttgtttttggtgggtgaatattgcaccgattcaacaacaggagatcagtgtctgagggtcctgtgttgccacccgaggcacctgctttgaccagggatggagagtcccatgcccaggacgaaggtttgtgtgctggtggtgagctagctgggagacgtggcacgggccgcttgtccctggccaccgcctgctgccaagggctccactccagtcccttgcctgtcaatcagaagatgctcagaggagaggcttctgcatcatcttcatcttgacattccaagagcagtaccgggtcagcatccacaaaagcacactgtaaaactgggaactgtgtcttacccttcctgagtgaaaagggaaagtttatgcctcagcctgaggcaggtgggccccttgccatgcacacctttgtcctgcagccagggatccacttggctgggctcaacccttccccgtcagggacgactgcacagaaaggagcgcggatagcagcaaggcccgccacggggaaggcctgcttcctgtgggtccccctgtgtggctggcagggagtggtacggcgctgggagtccagaatcactgaggacacggaaagcttcagcttctttgagaaaactcagattttgtaaatgcgcatccagttgacagcacttacggtggaatccgtggagttggacttgtgagaggccttgccctgagggggttcttggctggtgtctgtcctggaggtggatgccttgatggctgtgtctcccgtgctcccctcacccaggtcctcatcctcaggactgtgagacgccgttggacgtggaggagcctgaggagctctggctctgtgggtatgtctgctggcatttgccagttgaaacctgaaggattggaaaatgtctgtataccaattccaattaacaacaggaataataagcccattgcatataagcagcacattctttaaaaaaaaa

SEQ ID NO: 11575 - DNA, 1021 bp, Homo sapiens
ttagtaaatgcgcatacagtgacagcacttacggtggaatccgtggagttggacttgtgagaggccttgccctgagggggttcttggctggtgtctgtcctggaggtggatgccttgatgagatgtgtctcccgaggcacctgctttgaccagggatggagagtcccatgcccaggacgaaggtttgtgtgctggtggtgagctagctgggagacgtggcacgggccgcttgtccctggccaccgcctgctgccaagggctccactccagtcccttgcctgtcaatcagaagatgctcagaggagaggcttctgcatcatcttcatcttgacattccaagagcagtaccgggtcagcatccacaaaagcacactgtaaaactgggaactgtgtcttacccttcctgagtgaaaagggaaagtttatgcctcagcctgaggcaggtgggccccttgccatgcacacctttgtcctgcagccagggatccacttggctgggctcaacccttccccgtcagggacgactgcacagaaaggagcgcggatagcagcaaggcccgccacggggaaggcctgcttcctgtgggtccccctgtgtggctggcagggagtggtacggcgctgggagtccagaatcactgaggacacggaaagcttcagcttctttgagaaaactcagattttgtaaatgcgcatccagttgacagcacttacggtggaatccgtggagttggacttgtgagaggccttgccctgagggggttcttggctggtgtctgtcctggaggtggatgccttgatggctgtgtctcccgtgctcccctcacccaggtcctcatcctcaggactgtgagacgccgttggacgtggaggagcctgaggagctctggctctgtgggtatgtctgctggcatttgccagttgaaacctgaaggattggaaaatgtctgtataccaattccaattaacaacaggaataataagcccattgcatataagcagcacattctttaaaaaaaaa

SEQ ID NO: 11576 - DNA, 447 bp, Homo sapiens
atagacgtgagacactgcacccggcgcaaatgagctatttgataccagaggttaaattttgaacgtctagacacatgttttaaagattttttaggattttatttcagcttgtaccctaaactttaggtcttagattaccaaagtacaattatacagatagttgacttttctttttcagtttttaagattcactgaaatactttttccgtcataaattgatgcattgtaagtatgccgttcagtgatttttagttaagtttgcttactaaaagtaatttgtgaaatgggccaggtgcggtggctctagcctgtaatcccagcactttgggaggccgaggcttgcagatcacctgaggtcaggtgatccacctgcctcggcctcccaaagttctgggattatagacgtgagacactgcacccggcgcaaatgagctatttgatccagca

SEQ ID NO: 11577 - DNA, 396 bp, Homo sapiens
atagacgtgagacactgcacccggcgcaaatgagctatttgataccagaggttaaattttgaacgtctagacacatgttttaaagattttttaggattttatttcagcttgtaccctaaactttaggtcttagattaccaaagtacaattatacagatagttgacttttctttttcagtttttaagattcactgaaatactttttccgtcataaattgatgcattgtaagtatgccgttcagtgatttttagttaagtttgcttactaaaagtaatttgtgaaatgggccaggtgcggtggctctagcctgtaatcccagcactttgggaggccgaggcttgcagatcacctgaggtcaggagtttgagaccagcctggccaacactgcgaaattc

SEQ ID NO: 11578 - DNA, 1159 bp, Homo sapiens
tgagtttaccaaaacaaaaaaaaaattataaaaagtgaaagaggaggagaaggaggagatcaatccctgcctttgaggacattatgtttaattaggaagacaagattggacagaaaatattaagtttagaacattgaaagatgaaattcagaataagtgcaggtcatttgtgttgctcttggataataatagctttcagaaggtgggtctccagccaggacttgatggaattcagattgagagagagaaaaaggatattctaagagaagcaaattgctttaactgagggatgtcatgaatcattcattcgtatgtcatccagtatttactgagcacctacgtgtataatttttggcataatgcaaaggatgggcaaagagactgggtttgtggcagtgtgaagaagggagaataatttcttcggaaggtaggccttgtcctgtggtttttctcaaatgtgccatgttgttgtagccacaacacatgtgctgtctctgtctagagtgcatttgccaatctctgcctcatcctgtgagattcagcccagaccagatgtcactgcccctacaaagtcctctttaagctgaggttgagcaagatcacccttaccaaaaggtaacactggcaatctctctgctaactgcaaggtgagtagaactgagttgagaaggcagcagaatcctctcccctgtttccctccatccttcccattgggcacacactggcaaaaaaaaaaaaaagaaaagaaaaacaaaaagcaagtgatgtctgaagataccatgttagtaagggaggtacttgttaaccagacaatcataaaatgtttatagtttgtaagcagtgcccagcatgagaagaagcagctagattcgtgagaaagaataacagactgggaagtcagcaaaggccgctctggcatagtggcgtggatgtggtgttctgaaggaggaaggagctgaagagcaggccagagcacggggtggaggcttgccaagtctggagtttggtgagccaggggaaagctcgtgcaggataaggagggacagaaatgcaatgccggaccttggagaaggccacacagaccatttggaggagctgggaatttattctgattacaccaggaagccattgatgcatgtacaataaattaaaaaaaaaa

SEQ ID NO: 11579 - DNA, 520 bp, Homo sapiens
agatgagctacttgccctgctgtgtgcacggatggctcacagtgggtgcaggcggcctgcgggcacagtccacgctgtgattagcagcagcagagcccctggatacctctgcccagagctccgcggggtcagccatgcaatggcaccatcggatgagctggcaagggcctcccagacaggcggaaagagggcttggcaactgcaccatgtgtatgtaagtcccagctgggtgtccctggtgtcagtttctcagtctgtaaaatgggcatcatttggctgttccatggattaaatgaggggatacgtgcaaagaactttaggttcctcagagagaaatccagataaagttagcaaaagaacaggagtggccccaaatcctgaaagcccttggcaccttcttcctgtactctagacagatgccatctccctggcaccatctgtgcccacacccacaaccccacccatctgtgagggggtgggggtggagggcattctaaaggttttttgggatcctccccag

SEQ ID NO: 11580 - DNA, 880 bp, Homo sapiens
aattaatttttaaaagaatttagtcatcttaatctcacaaatatatttctgtcctataaagaaaaacttcttttttttccaattctatacacttttattaatacacttacaaaaaataacattcaaacactgagaaaactaaataactttggaagcagagctcattgttttctgcttacatataagtgacaattctgggctgttggcacaaaatagtcaacattcataaaaccctgactactatatatcaaacataagttaaaatcataggcagtagtttatcaaatccacgtttcttagaaaaacttagtatttattttgcattgaaatttttagtttttccagaatacaattaatttaccttttctgattaccaccaaaaaaccaagtttattatttaaaaattcagataacaatgaaaagtataaagaaaaaaatccatcctgtatctcaaattagggaacccacactgtaatttgagcagagttttaacataaggaattaacattgatattgggattggagtaacaaaggtttgactagtaagaagtaaagagaactctagacaatataagaatggcaactatcaggagcaactacaacccctaggtctgagatagagccctcaggaagaggcccctctttttacggatgagatccagaccctgttggagagggtgtaaccatggtttactggatggcagagaagttgatgtggtgttttgctctctaaacttgctcaaaatctcctttcttgagggttggggaaagctgcttacagagaggtatctcactggaggcattctgctacaaaaccacccagtggatcaggtgtaaggggaagctgctggctataggaggctgccagggtagtacacta

SEQ ID NO: 11581 - DNA, 305 bp, Homo sapiens
gcagccgcctactactactaaattcgcggccgctcgaccatacagataaatctttgtggatctggatttggcaaagttttcttaaacatgatgcaaaacatacaagcaaagaaaaaagcataaattggactttataaaaatttaaaacctttatgcttcaaaggatactatccagaaagtcaacagacaactactgaatggagaaaatattttcaaatcacatattggataaggtacatccatcttgaatatttaaaaacaaaacctcctacaaaaaactcagtaataaaaaagataactcaatt

SEQ ID NO: 11582 - DNA, 343 bp, Homo sapiens
gaactcctgggctcaagtgatccttccacctcagcctcctgagtagctgggaccataggctcatgccaccatgcccagctaaattttttgttttttgtagagacagggtctggttgtgttgcccaggctgatcttgaactcctgggctcaagctatctttccaccttagcctcccagtgtactgatattataggtatgtgtgcctgcccatccttttaccttgtatttattttttaaatttttatttatttatctttttatttattttgagacagactcttgctctgtcacccaggccggagtgcagtggcatgatcccgactcacttaaacctccatctccc

SEQ ID NO: 11583 - DNA, 455 bp, Homo sapiens
ggtacactcaagcttccttgctctcccttgtggcaaaaatatttgaattattcaattataccctgaatttggaatgggaattgagggtgttaggaaagtaacgtgtagaataaaagttttttttgttgacaagaaaataaattccttgctgtgacttccaaaagtcacccattcagcctgcatggtaactgaaaacagtgtcagtctggccagaaaggcatcagtgaccaaccgaatcattctagaccattaccccctatccaccgggtgttgcttgtcagaggagaaatcattaggggacatagggatggtaggcatgctaggaagccgccttggacatttgtccattaataagcactttcaccaatgacctcggaagagagttttactaagtggtgacaaagtttttactttacaagccttaagaaactgttcccttgctactagcattcact

SEQ ID NO: 11584 - DNA, 437 bp, Homo sapiens
gccaagtgtctgtggtacaaaggtgaccagcagtgccttccccccaccccccggggcagccaggcagccgaggtgtgacgagcaggaagctgtgggcggtgtttctggaatgagtctcccgaagataagcaacgtgcctgctcggtggggttcacgggctggggacgcaagggggctagcggggggcctgctgtccagctggaggcagcacaaggtagcaggagcagcccagagttcaaggccaggcagcccaggatgaatcgggtcctgtgttagatggactcacagctcccctgaaactcatgtccaccaaaacctcggaacgtgaccttatttgaaaagagagagtttctgcagatgtaattagtgcgggatcttgaaatgagatcatcctggaattaaggaggtccctgcatccaatgactggtgcccccatg

SEQ ID NO: 11585 - DNA, 509 bp, Homo sapiens
tgggtgagcttgagagaggcttctgaaagtactaaacaggcctcaatacctcagcaataactaatgctaggaagttggtgagaagactaaataggaggactcctgccctttgactcttggaaaataaatttttaagctgattttttcacttcagatccatggtaatccacagcagggctagaccttgttttaaaattttataattataatttcatttcagttctttaaaagtttggttacaaaaagaagcatatgtccctaatattactgctgtgtagtaagcactctgaagaggtacttatgtaagttctagtatcagaattgccttcgatgtctgttaaataattatagtgagggctgggcgcagtggctcacgcctgtaatcccagcactttgggaggctgagcgggcagatcacgaggtcaagagattgagaccatcctggccaacatggtgaaaccccgtctctactaaaaatacaaaaattaggccgggcgtggtggcttacg

SEQ ID NO: 11586 - DNA, 342 bp, Homo sapiens
tgagacagtctcactctgtcgcccaggttggagtgcagtggcatgacccccactcactgcaaactctgcctcccaggtttaagcaattctcccacctcggcctcccaagtagctgggactacaagtgggcaccaccacgctggctaattttcatattttttgtagagcctgggtttcactatattgccctgactggtctcgaactgctggtctcaagtgacctgcccgcctctgccccccaaagtgctgggattacaggtgtgagccactgtgcatgtctgctacacactttaaaatgaccagatctcactcacagttatgaggacagtaccacaagggatg

SEQ ID NO: 11587 - DNA, 309 bp, Homo sapiens
ctgccaggacctgtgaggaccgagtttcagatactgtggacagcggagactccacaggggctctgcaggaggagacgggaggcgatagcccctgcaaagctctggctggtgattggcatcagacttctcaatgagaaactgtactctagatttaattagaacagtatcttcaaaatactcgggaaaaatgatttcaaacctggaattgtagacacagacagactagaattcaaattgaagggcaaaggaaaagtgtcttcagatagtgaaggactcagaggttaccagcctcatccctaataccctgac

SEQ ID NO: 11588 - DNA, 499 bp, Homo sapiens
actggatggtactgaaaaagttacagcagcatttcagaggggaaagttccccttcatcaatctgcataagtagctctgaaaagaaataaagtggccccactgcagaagtagttctgaaaaaaacacaagaaacacctcaaaagccaccggtgctttagtaaagcacctccgcttctgccatctccccacaatgaggaagctccagtaccctgtccacatttctaaatggcactcatcggattcttaatgagttgcaggctttcccaacggacttgtgtgacagagccacgctctttgctcatctgcgtaatccccacactgaagtggagttgttcatgaaaacttactaaataatcaaatttcatcctctcaagcaggatatgcagtggtactttgctacaaatacatttaccactacgaatttctcacttcaagcgatctcctgcccaggtgtgtgctctcagaaaattacatctctttctgaattacgctggcaaag

SEQ ID NO: 11589 - DNA, 546 bp, Homo sapiens
gtcctagaggtcagtaaaaaagaagaacttggtctaggggaagaattatgaatgagagactgcagcagagctagaagatggtgcccagcagaagagaattggaacagatagatccctgctcttttagagcttcaacgatgaagcctattgttctgtggtttgaggaatgctcatcattcaccatagctggttaacataatttattaagttgaatcaagtacaaaaggaaaaagttctttctaataggccagattccatgagtggaaattccttggagtcaaacagggagaaaatacgtctcagtgttaaagactttccagagacttcttccattccactttccacccctccttaaatcactcgccaaagaaatgctttgctggacactaaagtggccacaaatgtgttcataagaaaacatcagaatataaaattaatcattgtctcttttagttaacttttttggagtgtgtgtgcagggttaaaggacagatgctattaagatgataaacatcagccaggtgcggtggctcacgcctgtaatcc

SEQ ID NO: 11590 - DNA, 453 bp, Homo sapiens
agggaatgttatgttagcgctcccttctgtttccataatattagtgtgtcagtttttccattgttcactgcttcacatctcgaaatatacaatctctgtgtgccatcaaaatttgaggtaacttgtaagaacgtatataatacaataaaaaataaacatcaaaatcacagaaaatacatactagaataataggtaaagggtgatgaaagtgagaagcatgtataatcataattcttcatgagcgaaaatgctatacagaatctttttctttaaatcctttgaatgtacctctttttaaagaaaaacaccaactcaataataaaaatagctacacacaagtcttgactgcctttttaccaactgcagtgctatagcttcctgattgccactataaaagctcttcttaacttactgttttaagatgaaaataagatatgcttctttaaaaaaaaa

SEQ ID NO: 11591 - DNA, 442 bp, Homo sapiens
taagaagttgccttaaattggaaacactttatgccctcagtagaaatgtactgaatttataaaggagatacagtaggaagtgagtgttgtattgtacatgttccataaacaaaatattagatcagcaatccatgtataaaggactattattgaggattttggatgccgtcatttattatagccataaactttacaaatgacaaaactttatcatatatttcttcctgtttctcttctaaatataaggatgataagaatttcttttaaaatcagctgtagagtacaagtttctctcccttattttctacaggcccatttagccacacagtcttgactgcctttttaccaactgcagtgctatagcttcctgattgccactataaaagctcttcttaacttactgttttaagatgaaaataagatatgcttctttaaaaaaaaa

SEQ ID NO: 11592 - DNA, 490 bp, Homo sapiens
agggaatgttatgttagcgctcccttctgtttccataatattagtgtgtcagtttttccattgttcactgcttcacatctcgaaatatacaatctctgtgtgccatcaaaatttgaggtaacttgtaagaacgtatataatacaataaaaaataaacatcaaaatcacagaaaatacatactagaataataggtaaagggtgatgaaagtgagaagcatgtataatcataattcttcatgagcgaaaatgctatacagaatctttttctttaaatcctttgaatgtacctctttttaaagaaaaacaccaactcaataataaaaatagctacacacagtatatgctacccatcagaaagaatctataggttgaagccatggattgaagtttttttgtcaaaacagtcattgattgttacttaggtcccccagtcacattccatgaagtgaattttgctgcaagtcacaatatcacagtttttctgtttgc

SEQ ID NO: 11593 - DNA, 371 bp, Homo sapiens
taaaaaaaaattacacctatcctagaagatgtggagtggtatctcattgtggttttggttagcatttcccaaatgactaataacttggaccatcttttcacatgtttagtggccattagcacatcctctttggagaaatgtctattcatgtctccactcatttttcagtggggttgttttttgagttgtaggagttgtttaaatgttcctgatattaaactcttacatgatttgcaaatattttctctatttctgtaggttactgtttcactttcatgataatgtcctttgatgcacaaaatttcaaaattttgatgaagtccaatttatctattcttttctgttattgcttgtgcttttggtgtcataat

SEQ ID NO: 11594 - DNA, 458 bp, Homo sapiens
ccaatttgtgctgttaattggctcagtctttcattctatactgagcactcatatcctgccatccttataaaaagggaagttgggagaccacggttaagagttaatggaaaaaacagataaattggacttcatcagaattacaaactcttatgcatcaagaatgcctaccaaggtgaaaaaaatagcgtatagaatggaagaaaatattgcaaatcatataatctgataaaagtttaatgtccagagtatgtaaagagtgcctaaaactcaataacaggaagacaatctaatttttaaaatgagcgaaggatttcattagacatttctccaaagaagatatataaatggcaaataaatacatgaaaagatccttaacatcattagtcaatagagaaatgcaaatcgaaacctcaaggagagattacttcacacctactgggatggcaattaaaaaaaaa

SEQ ID NO: 11595 - DNA, 452 bp, Homo sapiens
cgcgagtgatcaagatgagggttactggctccagactgaggctgatgggtcaggcaaagggagcacttagctcccacatggactcatcgcacatgcaaggagtctctataaacggtctcaacaagggcagtgctgtccccaagaggcgttttggaattttgtggggatgtttttggttgtcacaatgattggagggccttggtagcacttaatgggtggggccaggggtcctagcgatcctgaccttcacggtaccatcctgcacaaaaacttctgctggcctggtgtattagtcggggttctcttagagggccagaactcaaaagagagagagagatatatatatatttatttattaagtattaacttacacacctgtaacaggttctgtttgcagctctcacaaggtcccacaatagactgtctgcaagctgaggagcaaggagagccag

SEQ ID NO: 11596 - DNA, 176 bp, Homo sapiens
attagtaaaatgggagaatagactggaaggattttaagatttgttttagccctaaagatgatgaatgcattcagaaatcctggagaaagagttttggaacagagaacttaaggctaagattcttcactgttgtcatgatgatattgaccctgtcaagatttcacagactgcagctt

SEQ ID NO: 11597 - DNA, 734 bp, Homo sapiens
gtgacttttccgacagggaaggaggtagagggtacaggacagagaccaactgcacatactttacagtgatgcccaggctaggccagtctaaaggaaacaccaacacaggaagggatgtgtgcaggattcacaagggttttttttacccctgggagaaactaagtggtgtggtttcgctgaatagattttgctaagtacttaagcactgcagatgctccagtaatatgcccataagttcctttccaatttcaattactgggaaaatatacatatggacaatagatggatgccacaataaaaggctggcagcctaaccctcacatgaatttttccctacctctatttagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttga

SEQ ID NO: 11598 - DNA, 875 bp, Homo sapiens
gtgacttttccgacagggaaggaggtagagggtacaggacagagaccaactgcacatactttacagtgatgcccaggctaggccagtctaaaggaaacaccaacacaggaagggatgtgtgcaggattcacaagggttttttttacccctgggagaaactaagtggtgtggtttcgctgaatagattttgctaagtacttaagcactgcagatgctccagtaatatgcccataagttcctttccaatttcaattactgggaaaatatacatatggacaatagatggatgccacaataaaaggctggcagcctaaccctcacatgaatttttccctacctctatttagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgaaaaaaaaactctctctgtgtatctctctctctctggctctaactgaactaaagtgtatatcccaacttgcccattgagtcctgctgtgatttacatgaggccacttagaccgcttgagacttatcgctgtacattcttttc

SEQ ID NO: 11599 - DNA, 756 bp, Homo sapiens
gtgacttttccgacagggaaggaggtagagggtacaggacagagaccaactgcacatactttacagtgatgcccaggctaggccagtctaaaggaaacaccaacacaggaagggatgtgtgcaggattcacaagggttttttttacccctgggagaaactaagtggtgtggtttcgctgaatagattttgctaagtacttaagcactgcagatgctccagtaatatgcccataagttcctttccaatttcaattactgggaaaatatacatatggacaatagatggatgccacaataaaaggctggcagcctaaccctcacatgaatttttccctacctctatttagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttgg

SEQ ID NO: 11600 - DNA, 669 bp, Homo sapiens
ggttctggagccccacgaaaaatatcccctgataaataaacagtcggcggtcatcactaaaagtaatccagcctgttccatccccaattatgtgtccctaccggaccaatgtttcatcatgctgggaaaaaaccagggactttggggctggccttctcaaggaagccccagcttcttgtgattgagaataaagtgtgcaatcgctatgagtatctgaatggaagaatcaaatccactgagctctgtgctaggcatttggctggaggcactgacagttgcaagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttga

SEQ ID NO: 11601 - DNA, 4620 bp, Homo sapiens
cgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcatctgagcatgctgtgattgtaaaggagcaaactgcccaggctattgcaaacacagcccgtgcctatgagaagagcggtgtagaagcggcactgagtgaggtgatgctgagccctgccatgcaaggggtcatcctggccatagctaaagcccgtcagacctttgaccgagatgggtctgaagcagggctgattaaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttacctttggtgt

SEQ ID NO: 11602 - DNA, 3726 bp, Homo sapiens
gtgcatttctaaccagctatcaggaagttgctgaatttaaaatgttgtctctgtggagccagaagataggctttagatagtcatagtgatgtcttttttaaaaagtctctctctttgcctaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcatctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttacctttggtgt

SEQ ID NO: 11603 - DNA, 1771 bp, Homo sapiens
ctaattctaccttttatctgtaggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttacctttggtgt

SEQ ID NO: 11604 - DNA, 1881 bp, Homo sapiens
cgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtagaatgaaaattgatgggaaagtagtcaaggcatgtgctaatggtagatacaaaaatcaaatttgatagttttcttttaaacccaatgggaatccccctaagataaaagaataaacttaagatata

SEQ ID NO: 11605 - DNA, 405 bp, Homo sapiens
gactgttcagagaaatcatgagtagtagtatccgaagcaatgggaacaaatctccatcaagatttcacttttgtttgggtgttgtgggaagtcagagcatggaaactccctcctgtaatgaggcatttaatagacgcttcaagcacattagacctactgtccaccatagtctcataattctaccctagaattatgcctgaaagtactcagtgtgtcaccagggtaataaagttaatactcaaaactggttttaaattctatgattacttttgaaatttctattgtctttttctcccataggccagtaatggtgacattactcaggcagtcagccttctcactgatgagagagttaaggagcccagtcaagacactgttgctacagaaccatctgaagtagagggg

SEQ ID NO: 11606 - DNA, 4435 bp, Homo sapiens
cgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcatctgagcatgctgtgattgtaaaggagcaaactgcccaggctattgcaaacacagcccgtgcctatgagaagagcggtgtagaagcggcactgagtgaggtgatgctgagccctgccatgcaaggggtcatcctggccatagctaaagcccgtcagacctttgaccgagatgggtctgaagcagggctgattaaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaagtcgacgcggccgcgaatttagtagtagtaggcggccgc

SEQ ID NO: 11607 - DNA, 3114 bp, Homo sapiens
  misc_feature (14)..(14): n is a, c, g, or t
  misc_feature (17)..(17): n is a, c, g, or t
  misc_feature (25)..(25): n is a, c, g, or t
tgcaggctgtacanccncgaagtanggatatcgtcgaacccacgccctccgatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcatctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttacctttggtgt

SEQ ID NO: 11608 - DNA, 162 bp, Homo sapiens
aaagctggaaagaaacagaagtaagataaatagctagacgaccttggcgccaccacctggccctggtggttagaatgataataataatattaacccctgaccaaaacgactggtgttatccgtaaattccagacattgtgtgagaaagcaccgtaaaacttt

SEQ ID NO: 11609 - DNA, 1791 bp, Homo sapiens
tgcctccccttttcccaccccccgtcattcatctttcccgttgcctcctctcttcgcctcccgctaactcccgcctgtgtttccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactgaaaaaaaataat

SEQ ID NO: 11610 - DNA, 2832 bp, Homo sapiens
tagaagcaggcaagttgggtaacggctctcggcaaagttcgagaagtgcctatggccatgagtgagctgggcactcggaagcccagcgatggcactgtttctcatctgctcaatgtggtggagagtgagcttcaggcagggagggaaaaaggcgaccctacggagaagcaacttcagatcatcctggaggatgcacctctctggcagagattcaaggaagtcactaatgagatgattgtgaccaagaatggcagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcagtgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactgaaaaaaaataat

SEQ ID NO: 11611 - DNA, 452 bp, Homo sapiens
gacaaggcctctgagtcacatctggaatgggattctctggggttgggtcccaaggaagaactgcagctttgggccacccgaaaaacacaatgctatctttctttcaggtccatgaggaggcaagttcaggccagcggatttcaacgtaacccaggggggccctcagctcagttgagatctgtcttctgtcatggggcggggggcagccccattcagtcaaaggccaactcagggggctgcagcctctaagcccctgcccttcaggctggctttgctaatctctcaagaacacctgatttacacttaaaaaaaatcattccgctctgcccctttggcctcaaaagtttcctcaccagaaattcaatgaagatgcaatttcctttcgcccctccatagcaggcaggcaaaatcctgccaggaaccctttccactgccttcagtcccacccagga

SEQ ID NO: 11612 - DNA, 1284 bp, Homo sapiens
  misc_feature (697)..(697): n is a, c, g, or t
agactctatactctaatttctcatttaaaagaaattggactcttacaaaataaacatgatatgaacccagaatttaacttactattttcttactgttatcccaaagacattacatgatattgaacactttgaggtaattatggtactgggggagcataattgttcctactaatagaaacaaaatactaaggatttttctagaaactctcaagagccattacctggctaaggatttttctagaaactgtcctttcaagagccatttacctggaataaaagtgatgtgtatgataaacagttggctatacagacccaagatgaaattcaaaatatgacttctgaaaattctgaattcaaaatcaagtttttgatactttaggatcagctagatgatcatcataaatttgtctcctttccacttcaattttttttcatcttcaccaatctacactatattcaagccaacttaccatttcccttactccgttttccctgcaacttccctaagctgttagtgttattgtactactcttctttatgccacttaggcttgaattcttggcccaatttctctcacttctgcatgaagtcaccaaatgccagtgattctgcttctaacatatttcagacatcatttctgtccattcccactaccagaaagaaactctgtgttagtttttcttttacctttattgantttttataatagcatttatggcgtgttgaattgtggccccccaaaaatatgtccaagtcttaaccctggtgcctataaatgtgaccttatttgggaaaagagtctcacagatgaaattaagttaaagatcttaccctggattaaccaggtagatgctaaatcgaataaaaaagtgtctgtacaggaagagaagaggagaatcacagagaagaaagccatgtgaagatggtaacagacactggagtctgtaaccccaagtgtaatgcgacgggttctccaccaggttacttaagggtgtatgtccactgcttgagccctgaagactgggtggtgagccaaggtcatggtgctcagccaaggaacaccatgtgctgtgttccctgagaacacaaacatttgggagagtacctggggacataccaagaaaaacactcatcacacacagagaagaaaagccagaaaattagcttaaaagcagcttgaagatgggtggggtaagggggtgtgtggggcaaatttccagagttgtcctgctaccacctaggaatgccctgtatgttaagtcctaataaactcacctactcatc

SEQ ID NO: 11613 - DNA, 484 bp, Homo sapiens
  misc_feature (395)..(395): n is a, c, g, or t
agccctagtgggaaggctggggagagccagcgggccgggccgagcccagtggcgcggtgtggcagaggcgatgatggtgccagtggagcgatgggaacccggccagccccgacaggagcaggcaagatggggccgagccgcaggacagggcgggacgacggcctcggcagggagggcacagagacccacaccccaccgtgacgctgagaaccaccccgtgcctgccaacacacacgtgggggccatggcaggggaccgctccccactgctcaccaggccggcgagccatccagcccaccccacgacacgcacacacagtttcgtccccgcacgcgtgtctctctctaccccctctctccctcccgagttctcctgctctcggggcaggcggggcntgcaacaaacaaagggcacaaccccaccagcacacgtgctgcacggggaacacggtcggccaaggaggaaggacacgttggcgcctctg

SEQ ID NO: 11614 - DNA, 3206 bp, Homo sapiens
agcggccctttttgcataatggtagttgatttttgcagaaggtttgtggccagatcgctatgtataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccagggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctta

SEQ ID NO: 11615 - DNA, 3097 bp, Homo sapiens
aagggctggacaccacctgcagtgtcctctaccatctgtggctggcaggatcagttgcattctcactgttctaaacctttcttttccagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctta

SEQ ID NO: 11616 - DNA, 3579 bp, Homo sapiens
aaaagattttatcttcttttgttacaagaatgaacttgaaaacttaaaaggaaattaaaatataaatactacagagtcacataagcctagattcaagtcctggctctgctttttaccagatctttttcctgttatttaacttctgagcttcaatttcctggggctaaaatagtacttgcctcataaggactaaatgagaaaattcatgaaaagcatttattacagtgtctggtgtattgtaagtagtctagaagttcgttattatttttaactttcacttataaatattggaatattagctgaaaggaactctagagatctatttcaatctccttgttttacctctataggaacttaggttcaagggaatttacgttgcttgtccaaagtaaaacattttaaaaagtcttgttaaggatggtcttttgccctatgtggcatagaaatttcagttaaatcttaattacattcattacttttagtaaataaaaataagaatctagaagaatagccaaggttacctgaaacagatgttcctgatttctctctccctctcttatgagtatcactaggagccagttatataagtcaagtacatgtggtgttggttactttcatctgtttggtcattgatcactcatttggtgatttgtatcttctgagtgcaggccctttagggaaaacagctgtgattttctagaagctcctttttagcttctctgatgctgcagcttatcctgtccattctatttcagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctta

SEQ ID NO: 11617 - DNA, 3218 bp, Homo sapiens
aagggctggacaccacctgcagtgtcctctaccatctgtggctggcaggatcagttgcattctcactgttctaaacctttcttttccagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgcaaccttctcatattttatatacttagatggaaaattattttttcattacagttttgatttatgtcacataatgtgtttcttttataaagaaaagtcgttgctttttaacttta

SEQ ID NO: 11618 - DNA, 1292 bp, Homo sapiens
aacagtagtgggttttgaaagctaaaagaatagagtcatcaagcctagacattccccagcacatgcagtctttcactctatctggctttgcccgcaaaccccagaggcctctgctgtggttacctcatcgctttgaacacagcgcttttcataaattcttaccacatcactcatctttattgcacgcagttaagataaagcacagaattccccaagcagggcagctttttgcttttcttgtctagtcttttttcctgtgcagtcacgagtgcattttacctaatttacacatgaaaatgctcttagaaaacgcaaagccatcaggcaccctcaaatcagtgctcctggccagccctcccagtgggacattacagatcagtgtgtgacataacgtcttccttcatgctatgttaaggaacaagaaattactctcttgtaaataatgtgcacttttcttaaagttctgatgttctttttgaaatcacatttcaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctta

SEQ ID NO: 11619 - DNA, 1002 bp, Homo sapiens
gggccagtggatgcaaggcctagaacaccaggcagcccggtaatgctctctcttcctttctagtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctta

SEQ ID NO: 11620 - DNA, 1701 bp, Homo sapiens
aagggctggacaccacctgcagtgtcctctaccatctgtggctggcaggatcagttgcattctcactgttctaaacctttcttttccagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatggttagtgagtagctgctcctacaaatgtctttttcatgtaacttgtagtacttctaagatgagtgaccaccaaccaactccctttgggccataaatgtgtgatctgcagagagtttagcgaagttttatttccttatgaaattaaacccttgtttccagggcaagcagaggaaatatactctgaaccaagcatgctggagggtgggccataggttctcttcccaaaatatatgatgggactgtggatatcaaatgacctgcaaaaagaatctccttttcagccaatacttattatcactccaacattttactttaaatcaacaaggatacattatttagaaccactgtctctgggacattccctctctcgaagtcttaaaaaaaaaaa

SEQ ID NO: 11621 - DNA, 2028 bp, Homo sapiens
aagggctggacaccacctgcagtgtcctctaccatctgtggctggcaggatcagttgcattctcactgttctaaacctttcttttccagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactcttcccagcagcaagcaccagccttccacggcaacacggtatcttcgtgcagctttcctgtttacactactgcttttttattaaatggtgttcagtt

SEQ ID NO: 11622 - DNA, 426 bp, Homo sapiens
ttagaccagccaaactgtagggcacacatcagctgaaggcagacacatgagtcagcctggtctctattgcctgagcctgagggcaccagcagaacattccagcatatcattagactactgaaccataataaatgttatttgtttaggctcccaaatttgggggtggtttgttacacaacacaaatcgatacaggagtgaaggaaagaaaattaagaaattcatgagcatttagggaaaggctcttcatgaactgtcacaacaaagtgctagtaaactttaggctcttatttagacttataataatttaatgtgaattatcatgtaaaagtagaaaagctaaaagaataggaaagaaaatagagaagagaaaaggaaaggggaaaaaagaacaaacgagaggaaaggagaggagaaaagaaaaaagg

SEQ ID NO: 11623 - DNA, 503 bp, Homo sapiens
tgaggtagatgcagcaatattcctggggtaagattctataatactcctgtattggcaagtggactggaccaacagacacaggcctcagccactgtcgctagggactgaaggagagttcatggattcttaccccctagtcatgaaagctattctggccagccttgaatccatttaattttgcccacgagaacctttcatgacaattaacaagacactagtttccccataaaagtccatttttaaatatatagtatgctaattagcagtgtctgttgaattgccctatcggatagcagccaccatgtgtgctgaccactcacgattcagacttaccttggaaaatatcacactgacgatacagtactttagaataaattgcatattgtatcaggctccgagactaatttgtactgaacccttgatatagattaccttttataacatcaccacctgtcatgaagcttatctgttttctgatttgaataaactttgtgttgtgcacc

SEQ ID NO: 11624 - DNA, 499 bp, Homo sapiens
aatattgggcaataaaataatctctagtgaaaacaaacaggccagatgtggtggctcatgcctgtaatcacaacactttgggaggccgaggtggccagatcatttgagatcaggagttcgagaccagcctggccaacatggtgagaccttgtctctactaaaaatacaaaaataagctagacattgtggcaggcacctgtaatctcagctacttgaggggctgaggcaggagaattgcttgaacctgggaggcgaaggctacagtgagctgagatcacaccactgcactctagcgtgggaaataaaccgagattcatgtcaacacaaacaaacagaaaaaaaatacaagataattattttgtaactcaagaaaaattttaaattctgactcaaaacccaaaaagtataatgaaaaggttgataaattcaatcacattaaaaaacaaataacttctgcatagaaagaaaacattaattaaagagaaaagacaaactgtga

SEQ ID NO: 11625 - DNA, 498 bp, Homo sapiens
  misc_feature (17)..(17): n is a, c, g, or t
  misc_feature (253)..(253): n is a, c, g, or t
  misc_feature (285)..(285): n is a, c, g, or t
  misc_feature (396)..(396): n is a, c, g, or t
gctttacatccccagangttctagagagagatggcaaggctggagaaagaaaaaatgtgttttttttctgtctgtatcctaatgacaagctacatgcaaaaggctgaagttgtgccttcatatacaaaaattaattcaaaatggatcagagacctaaagttaagagctaagattgtaaacaacttttttttttttttttttttttgagacagagtcttgctccatcgcccaggctggagtgcagtggcacgantctccgctcactgcaacctccgcctcccgggnttcccgccattctcctgcctcagcctcccgagtagctgggactacaggcacccgccaccacgcctggctaattttttgtatttttagtagagacggggtttcaccatgttnagccaggatggtctcaatctcctgacctcgtgatccgcccacctcggcctcccaaagttctggggcgtgatccactgtgccaggccaattgtaaacttctta

SEQ ID NO: 11626 - DNA, 296 bp, Homo sapiens
gtagagaaaggagaagagtaggaaataatatcagaaaggtaacaaggtggaggacacatcatgtagggcctagtaaggtcattttaagaactatgagtggggccaggtggagcactctgggaggctgaggtggggggattgcttgaggccaggagttcaagaccggcctggacaatatagtgagagtctgtcagcacaaaaaataaattagctaggcctggtgatgcatacttatagtgctagctacttgggaggctgaggtgagaggttctcttgagcccaggagttcaaggtta

SEQ ID NO: 11627 - DNA, 352 bp, Homo sapiens
ctacatgaatgttaacacggccctacagtattttcttttgagcttgatgtatttaaaaattgaatgaactaccatacagaagcagttttagaaaggaaacaaggaggccaaagtgggaagatggcttgagtccaggagttcgagaccagccagggcaacatggcaagactgtgtctctaccaacaaaacaaaacacacaaaaaattgctgagagtggtggtgtgtacctgtagtcctagctactcaggaggctgaggcagaagaatcacttaagcccagcagtttgagcctgtagcgagccatggttgtgccactgcactccagcccaggtgacaaagtgagactatctcaa

SEQ ID NO: 11628 - DNA, 350 bp, Homo sapiens
cacagtatctgctcccaaggtaacagctgggaacataagggtgatgtgttagtctgtctttgttgccataaaggaatacctaaggctgggtaatttataaagaaaagagatttaattggcacacagttctgcaggctgcagaagcagcatggtgctagcatctgcttctggtgaggtcctcaggaagcttacaatcatggcagaaggtgaactggtggccagtgcatgacatggcgagacaaggagcaaggttggggaggtgccaccctcttttaaaacaaccagatcctgtgtgaactcactgagcaagaattcactcatcagtaaaaggacagtgctaagccattcat

SEQ ID NO: 11629 - DNA, 1410 bp, Homo sapiens
cacatttcattgtaaacgactgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctgggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgagtgggatctggtatgtgactctcaatcactgacttcagtggctaaatttgtattcatggctggaatgatggtgggaggcatcctaggcggtcatttatcagacaggtttgggagaaggttcgtgctcagatggtgttacctccaggttgccattgttggcacctgtgcagccttggctcccaccttcctcatttactgctcactacgcttcttgtctgggattgctgcaatgagcctcataacaaatactattatgttaatagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaagattttgaaatccaccatgaaaaaagaactggaggcagcacaaaaaaaaaaaccttctctgtgtgaaatgctccacatgcccaacatatgtaaaaggatctccctcctgtcctttacgagatttgcaaactttatggcctattttggccttaatctccatgtccagcatctggggaacaatgttttcctgttgcagactctctttggtgcagtcatcctcctggccaactgtgttgcaccttgggcactgggggtcagggagagtctccagcagggggagggtgaattgtttgggactatttgttcttcag

SEQ ID NO: 11630 - DNA, 1534 bp, Homo sapiens
cacatttcattgtaaacgactgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctgggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgagtgggatctggtatgtgactctcaatcactgacttcagtggctaaatttgtattcatggctggaatgatggtgggaggcatcctaggcggtcatttatcagacaggtttgggagaaggttcgtgctcagatggtgttacctccaggttgccattgttggcacctgtgcagccttggctcccaccttcctcatttactgctcactacgcttcttgtctgggattgctgcaatgagcctcataacaaatactattatgttaatagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaagttggctgctagagtctgctcggtggctcattatcaacaataaaccagaggaaggcttaaaggaacttagaaaagctgcacacaggagtggaatgaagaatgccagagacaccctaaccctggagattttgaaatccaccatgaaaaaagaactggaggcagcacaaaaaaaaaaaccttctctgtgtgaaatgctccacatgcccaacatatgtaaaaggatctccctcctgtcctttacgagatttgcaaactttatggcctattttggccttaatctccatgtccagcatctggggaacaatgttttcctgttgcagactctctttggtgcagtcatcctcctggccaactgtgttgcaccttgggcactgggggtcagggagagtctccagcagggggagggtgaattgtttgggactatttgttcttcag

SEQ ID NO: 11631 - DNA, 1255 bp, Homo sapiens
cacatttcattgtaaacgactgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctgggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgagtgggatctggtatgtgactctcaatcactgacttcagtggctaaatttgtattcatggctggaatgatggtgggaggcatcctaggcggtcatttatcagacagtagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaagattttgaaatccaccatgaaaaaagaactggaggcagcacaaaaaaaaaaaccttctctgtgtgaaatgctccacatgcccaacatatgtaaaaggatctccctcctgtcctttacgagatttgcaaactttatggcctattttggccttaatctccatgtccagcatctggggaacaatgttttcctgttgcagactctctttggtgcagtcatcctcctggccaactgtgttgcaccttgggcactgggggtcagggagagtctccagcagggggagggtgaattgtttgggactatttgttcttcag

SEQ ID NO: 11632 - DNA, 546 bp, Homo sapiens
gattgagtccaacagactcaatcatacatgtcatacatgtttatgattaagagatattctttttgtgtgctagttgattttgccgagaaaaaatgaagaagaattcaagaatgagatgagggtaggtaagctctcagagcatttctgtctgccatttggttctatgcttatgtggctgctaatgtgactaattcagagtgttgtatttccacatctgtggactccaccatggaaaaggtgggctaccattggtccttatatggctttattagaaaaatagacattctatcgtttgtctgcccagtggccagagtcctggtgaacaacagagctcatgggaaaccagcctctctcagggcaccccgctatgaggatattgaaatatgttcaatcatttctcatctcccttggaatgtaattccctgccctatacaaaataggatattccaatgcgctatttgaatctagggattgaggatttgtagttgagttttggggtaaaggcttggctcattgccatggaagaataaaagttatttattaata

SEQ ID NO: 11633 - DNA, 500 bp, Homo sapiens
tataggtatccgaaaattacatagagtgcatggagcatactgaatacctcgctcttccttctgtgtctgcctccaggtgtcttcttcctgtagaagtccaaatgaaacaccttatttccaatcacagccacaacctgggggagaagaatcaaatcctccacagggattgtgatttctgcagatatgaataatccatgttcctaccagctgccaaaaaaacagcttttggaaacaagatgtactatttggcgcaaggttatagctacgtgacattttggcaagacaggcttttttatgaccacagaggaatttgaagaggcaggaacacaactgaaaaaaaatctcttccctttatggtatgtgaaggtgtggtttcaagcaaagaaatatggtagaagaagatggaggaaaatcataatgcaaggcaaatataaaaatggcacaaaacattagaaagtgctggaggatgccaaagttctgaatggaccaatgcttgaaaa

SEQ ID NO: 11634 - DNA, 204 bp, Homo sapiens
tgtagggagaagggactggcgatgctgtgttgaggcagatacgtggattctcagttccatcacctggagtatctaaaaggctaaggagtgggacatggcagcctgcacctgtgttccagctactcgggaggccaaagcaggaggatcatatgagccccggagtttgaggccagcccgggcaacttagtgagactttatctcaaa

SEQ ID NO: 11635 - DNA, 266 bp, Homo sapiens
ttaggagaaggtctctcctgtaagtgctcttgacacctctcggatgggaactgtattaactacaggagaaaaaaagtgggagattctaacattctgactttgctcagatatcttccttccctcaaagtacacatcctgagcacccactaatctggtcactgtgggactgggaactttcctctaatgagcttattatgtgaatcctgacacagagccaagagtcaagagtagccttcagctgccagaagacctgcaggttttcttta

SEQ ID NO: 11636 - DNA, 820 bp, Homo sapiens
gtcagtcccttcacccagaaatcagtagaatgttagcagttcagactcaaaccttgtgaaaaacaggtggtggaaaggaaatccctcacagcaactggcaccataatcaagacaatgtttacagaataaatggagttacctgctttcagccccaggtcgtagctattgtctgccctgctgatatgtgataataatttgtgatcctgttgtcttaaaatggggtcactcatctccagtagaattaagtccacagtgaagttgtccccccatccccaaagagataaacatatatgaatgaactcacgtgataacaactactgctgcctgggatcatgagagacctgaactgaactgataggatgtgaaaggtggctgagataatgagaatagacccatctgcagaggatcataaaaccagcaaagacaagatcttgtctaagatgccttcacaagctttgtccatgagaactcttaaggatttcaccagacctgttggctgctgctgtgatctctgcccaagaggagcctctgaccaacatccaaagggcttctggacccactggactcctctggaggtaccttggtctcccgatccatggctgtggttttttactccctttatcactgcctgtgtgtagaatgataattgcacaattgatagtgtgaagacctcttgataaatggtaaatctgagcatatgtatttggctgacatgtcattgtgaaacctcacagcttcagtcagtgtctctccaaggactaaacaatggaagactgtagaagatgctattcattaagatatcgcaagaatatggaagact

SEQ ID NO: 11637 - DNA, 447 bp, Homo sapiens
acttgaaaagactgggcgaaacaggtgccttttgttccagaccagttagtcgattggtgtggtttgtatgtggggttcctggagggtttacatgaatcctggtgattatccgcatacatatcccaggcctgagaagggcccagggtctcccagggataatggaatcagtctgctcatatttagtgcttcatgtggacatggtgtttccactgtttgggtatttagtcgtcatggtaaatgctgccacttccatttctgatgctttcgtaatgttaggatcactcagtattagtgccaggagggactcatgtttcatttagtctaactctcatgctaccaaataaagtcaacactggcactggaagaagtcatattattaggtgagcttctgaaattactgaagttattaagtcagtcaattgtttattaaaagaattggctaggagt

SEQ ID NO: 11638 - DNA, 461 bp, Homo sapiens
ctgcccgggctctctatccttgacaggctgccttgaagttgagcccagactgattttcttgcctcagaccccactaccgtgcctgggactcatgcacctttgactcccatggaagggaagtgcagtagtttcccaggtgcaattctggtgtcctcacccacattgaggatgtacaagaatcaggttcttagagattggagaaagaaggaagaatgggaacaagatttttcccaaaggactgtgaggtcccccacctaaccttgatgtgagacaagtgaggttaaccccaagcctggtgagaagcgttcccatcagacacttggaaatcctgaggactgtttcatgcagaaggatatggtttattcaggtttgactcgtgcttgagaaagctagagcctctggtggtgaatgattttaataactatttcctttccaccaacatatacagtacaaataataat

SEQ ID NO: 11639 - DNA, 283 bp, Homo sapiens
ctccgctgtgcagagggcggtgaagccaggagacggacagcacagctccctcgggctttgactctactcgaagctttgaaaaaaactattttgagccaaacacgttcatctctcctgattttaatatagaagcaaaagacttcaaagagctcttgttggggcattgctgatggcttcacttccggcaccccagggacgtgaatcccccgccttctggggaaaggttgagaaacatctagaattcagctctccagggaaggtggatttaccttagagtttgggg

SEQ ID NO: 11640 - DNA, 366 bp, Homo sapiens
gcccgccttggcctcccaaagtgctgcgattacaggcgtgagctaccacgcctggcccctggcccatcattttacaatttttaaacattttatagaaataattttaagtttacaaagcagcaaaaataaaatagtatgaagaacacttatataacttttgcctagattcacctgttgttaacattttatcccatttgttttagcatttgtactcttatctaaataaaattgtaaatgtgtatatatacacgttgtttacatacctgtctatagtgtgtacatatacatacattatttataagctatataatgcacacatataatcacaacatttaatatatattatgtattgatacagtacttgaa

SEQ ID NO: 11641 - DNA, 354 bp, Homo sapiens
ctcctgcaaagcaaggatgcagttcatttccagccctgagctgcactcaggagctgggcctcatgcccagtccccatccttagggcagtgcccgccctcaggctgacagcctttcctttccttgctccagtcgcttgggtgtgagtcctgcttctcccattttctctgtgctgggacctcaaggcaagccgactgcaagcccacctggcccaggccactgcagggccacccttcgcagggccaggctgtgaagcagttggaggcgaggcccggggctccaggctactgtgttgagattaatcttaccaactagaactttaaaaattgtgtttccagcctttatttgaaagtggg

SEQ ID NO: 11642 - DNA, 556 bp, Homo sapiens
ttgggaggcctggagagggaacgattggctaattgtgccgaattcccggtcgtttgtgcagtccggggagcgtgcgtgcagccaggacttggcttgttcgatctggggaccggcagcgacaggcacaacaacaacaaccgagtttggcacttccttcccagtataaataatgtacctaaaatggctgacatcattacaagcctaaacctctgttgtttcccactttcgtttctaggcttgaacagcacttggactaagtccagcaactgtaagcgtcttaattttaaaagcgtttctttacctcctttttccacggcccttcggtagtggcaggtgaacttcacctggagaggggacgaagggacagtccgcccgaagtaggtttgggctgtctcttaccattactagtaaaggccagtaatgactatgtggatgttagtgaaaaaccaattgttggcatttaaattgtatcagcgtctttgtgaggactcctgctgcgtgaaactaaacatgagaaatttgcccccgggtccctaataaaattctcctttatttt

SEQ ID NO: 11643 - DNA, 269 bp, Homo sapiens
tcctctgctctctgttcctggaaactacgagtccaactgccaaccccaggtggccccaagttgtggtgaaaagaacaggccttaaaggaaattgtttcagttcagccacttactagcccttcaatttaggggaaattaagaaatctctctgggtcgggcgtggtggctcacgcctgtaaccccagcactttgggaggccaatgtgggtggagagcttgaggttaggagtttgaaaccagcctggccaacatggtgaaactctgtctcta

SEQ ID NO: 11644 - DNA, 628 bp, Homo sapiens
  misc_feature (42)..(42): n is a, c, g, or t
  misc_feature (137)..(137): n is a, c, g, or t
ctgtgttatcaacaatcaaatataaaattattgcatcatatnacacttcaacttaaatactcatgtcaatagtagtttgaaagaataacatttcgcattttgtacttttttccgtgaatatcagtgaaaacggagtnactcgttttgttgtttttttaacttcctaataactttgacagttgggtaaatttaagtaaaccacacactgacctagggaatacaggactttctaaaatcaggcaccctaatcggccaacccaaaaaaaaggacaaaaagcttttctcagtagttcccacgaggacatttttaatttataatttgatattgaaattacaattatacaaactataattggaatgaaataagcagatacattcctattctaaattccttgattcacttaaaatgcatctactgcagtcctaatctatgcataactcttcattaggtgatacttatggcaagacctaagtgtgaccactctcaaattttagtgagtttctaataaattctgttctgaaggcacatgtctctgtcttaaatagactctgctctgggaatgagtggtagaaccaagtaagagttcccagagggacagtgttcccagagaaaagaattaaaaccatg

SEQ ID NO: 11645 - DNA, 890 bp, Homo sapiens
ggccagagttgcatttttcacatgagcaaaagttacatgcagaaaaagaacagaagttcgttgattgtaggatatgtaaccttgagaactttatcttatagccaacggtcacacattctgaaatgtcttaagtgatctggtcagtgctaaaggtagtaagaaaatctggttgctgaaaatttacactatctaatttcagttattcccccacaacagagtaacaggcaagcacattctcagcagccgttccaggcagagtatacacagaaatacttgttgaatttaattgggttgaataaaaatttgtccttttgaggaacaaagttagcatctcaaatacaaggtctgcaaatgatgtaggttcttcttagttggctaatgaactcctgactagttacagatgaaagggattaaaatgactttactgagcactcactttagtctgtttcattatctgaactaaggaagtctaagacaattaggattccttaaaaaaaactttcatcattgcacttcctgtttgatgagtaaacagcaaactcgttatggtctgcaaggtaccctattaaaacccgtaacatcccctggaaggaagtaacttggagaaagtcaagaaatctttctgacaggacaccgcaactccaaacaatcaacaactcattgtcatagtgcgacaatcttagccctgttgcaactgggcaaatagtccatttgcagagagaagcatcatcggggtagacaggaatgctgttattaaccattataagtatgacgcgaaggtcgtacatcaggctattacaccttttcattatacgctaacccctcacggcagggaagccacgcttatgactgcattagacagacaaagccttcagctctttaaaaaaagg

SEQ ID NO: 11646 - DNA, 712 bp, Homo sapiens
cctcatgtttgagtcagtgattataatagaagaatagtaaagctgtttatttattgtgtgtttaccgtgtgttctaattgttttgcatgtatcaactaattgaatcctcagaacaaccctgtgagtttggtactggtactgtctcaggggtagagctaccctcattagacagttaggacttgaacttagattctctgattgcaaaatttgtattaattctgccctactactactgtgttattcctgtcctgcatgggagaatatatagttcataacaagatcaaaatggctttttgtgtgtgtgtgtgtgtctaactagtatccagagagaaccttctgtagtgtataaaatgtggcaatcggggccaggcgcagtatccagaaagaaccttctgtagtgtataagatgtggcaatcagggctggagcggtgcctcacacctgtaatcccagcactctgggaggccgaggctgggggataagttgagagcaggagttcaagaccagcctggccaacatgatgaaacccccgtctctactaaaaatacaaaaaaattagccgggtgttgggacgtgcacctgtagtcccagcttcttgggaggctgaggcaggagaattgcttgaacctgggaactggaggatgcagtgagctgagaacgcaccactgcactctagcctgggtgacagagctagactccatctcaaaaaaaag

SEQ ID NO: 11647 - DNA, 701 bp, Homo sapiens
caatttccaggacactttattgtaatttccactttacatattaatttaatattttagtctaggcagaaatgtttatacttatacaacagtagtccaatcctctaatctcacaaaatgaaaaggagcagttttaaaagaacatcaattcaggtatttatgatatgggggacaaggggcacttgtcttagctggaaaaggggctgatgcctttcagtacgagtttcactgaaattttttctgtattatttttcttgttgatgctaagtactcaaataaaagcaattgcactttttctcattctgccctctcttggtctttacattctgtctagcatttaacgcaaaaagtcagtttacattcagttaacacataaaaaaaaaaaaaccatatgccccacctcccacacatccaaatggacagggattagaattaacctggcttttagctgtaacagtgctattttaaaatttttcaaccacacacttgaagggtaaaataatttaagatacaaaaccaaaggaaaccataacaattcctacacatttactatttaactgttctcaaatcatcaagtataacatggatttcttaaaaagtgaaatcgacacaaaagcgaatgcacgcttaatgtacaaactgaccgtggctctgtggggacagttctctttgaatgagctattatccagacggtggaatggaaa

SEQ ID NO: 11648 - DNA, 978 bp, Homo sapiens
attttgttctgtactaagaaaaattcttctgccttgggatgctattaatctataaccttacccccaaccccctgctctctgaaacatgtgctgtgtcaactcagggttaaatagattaagggcagtgcaagatgtgctttgttaaacagatgcttgatgacagcatgctccttaagagtcatcaccactccctaatctcaagtacccagggacacaaacagggcgaaggccgcagggacctctgcctaggaaaaccagagacctttgttctcgtgtttatctgctgaccttctctccactattatcctatgatcctgccacatccccctctctgagaaacacccaagaatgatcaataaatactaaaaaaaaaataaaataaaataatcatacaaggaccctaagataataaattctaaaacaggatttgaatccagccattctttttaaaaaaaaaaatacatatatttttaagatgaagtctcgcaatgtttcacaagctggtctcaaactcctgagttcaagtgatctgcctcccaaagtgctgggattacagggttgtgccactgtgccccgccagaatccaagcattctgactccagagcccaaagccataatgtcactctgcctttcagcactacacatccaaaatgactatcttctctcttctgaattccccttgcattttacctgtttaatagagtaaaaaggatgtaatatgtaggtatgtataggaatgtatacatatgtatgtaacatgtatgtgtctttcctagactctaagcctcttgagatcaaggtccacccacatgagattcatctttgtatctgctaggtatccagcatagtagatactggatcaaatgtttactgaatagatgaagctacatatcagtcttaagatttatttttgaaataaaagtagtttcttatagaaaaaaataaaaataaaaaaataaaattgcccaaatgattttt

SEQ ID NO: 11649 - DNA, 519 bp, Homo sapiens
tttttcactaagccttgaaaatttattttcaaagtgggttgaattttaggtcatttgtgcgggtatatctaatgaagagaaaaacaaagtgatggagaaggaatttctaataagatcttagtattcattagaaatataacctcttgctttcataattaataggatctgaagttaatttaataaaaatttgacttatatactaaaacaggcaagatttgaacctggctttattaagtttttattttagtttacatgtttgtttcaaacaagattaaaaattaagaattaaaaattgatgtttgtctggatttttacaaccaattattagatctatggcaggtatccagccatttaaaaataacagtgtaaagcaaagcctctaattttaaagaagaaaaggaatccgaaagagggatggctatagcaaccttgatgataaaggaaaatttgtgcagaaaagcctgcagtaaacagattttcttagacttaaggcatgtccttagtttatcatactcagaa

SEQ ID NO: 11650 - DNA, 504 bp, Homo sapiens
gtaaacaacagtaacaacaatgacaacaaagcctatggttatgtctataatcttttggtgcaaaaccttcttgtcttgtctttttctgcttatcaccaccctctttcttattttcaccaatctggagatgcatatacaaaaacattttaaaatccactttttggccaggtgcaatggctcatgcctgtaatcccaacactttgagaggccgaggcgggaggaatgcttgagcccaggagttcaagaccagtctgggcaacatagggaaaccctgtctctgcaaaaataaaaaaattagctgggcatggtggcacatgcttgtggtctgagctactgaccactgagctactgaagtgggaggattgcttggacctaggaggttgaggctgcagtgagctgagatcatgccattgcactccagcctgggtaacagagcaagaccctgtcacactcacacacacacacacacacacacactccacttcgtttctaatcatggtgtat

SEQ ID NO: 11651 - DNA, 348 bp, Homo sapiens
attctgagtttaaatgaaaggaagtccttttctaacatagttagaaaagagttctcttactcaacctctcactcttatctgaagtctcttttcaatattgttttgacttgtaatttattgtaagtttaagcaggtctcaaccattcagttatacctcttttcaagggataagattctgagtttaaatgaaaggaagtccttttctaacatagttagaaaagagttctcttactcaacctctcactcttatctgaagtctcttttcaatattgttttgacttgtaatttattgtaagtttaagcaggtcacaaagatttgaaaaaaaaaaatctgtattaaaaaaattc

SEQ ID NO: 11652 - DNA, 427 bp, Homo sapiens
acgctctgctgagggtatttcattgcataagcctagcctgattgcctgaaatctggcacgtaccctcttggagggggaggggtgagaggggaggaaaaggcttgaatgttggcatgcttcaaagcgctctctatactttccagaagctgatctaaggtaagacctggcttgtttgatgctgtccctcttcctttcctcttaagactctacctcttcacttcttgacttctctacctaagagaatacacagaaaagctccctcttcagactgattttcagaaccatagccctcaagtctgacaaatccagggcggattcagagaaaaccctatacatcccacccccaaccctgctgcctgtctccctcctggctctgtagggctccattcagtcgtccctgcagcccgtagccagagagcccctagaa

SEQ ID NO: 11653 - DNA, 547 bp, Homo sapiens
ctttttacatctagatacactttctaattttaagaatttacatctagataattttagcaaactacatctagctacactttctaattttaacatttttatttaacagtaaaatattcccaaggttaaaaacctttatttgctttcggagacaaaaaaacaaaaactatcttctaagaggttggagtttatcaatttacagtttaaaataaagttaaaattcggaacacagctcattcatttaattaacacatactttggttgtttttcactatgagcctttcagtcctactactgttggtctttttaatccatatgcagacattactctaacatttttaaaagccaatttttcaaattagttgcccacattgaaagatcagaagatcttacatgataatccagctttttttttgcacctcgagggacaaaaaatcatgcttagaaaacgagaaaaaaacagaccacgcatgacttttatttataaacagtacgccgtgctatttaaaaccaagggattaaggactcctaggactaagacactagttcc

SEQ ID NO: 11654 - DNA, 261 bp, Homo sapiens
cattgatgagcatttaggttgagtccatgcctttgttattgtaaatagtgatgcgatgcaatacacgtgcatgtgtctttataataaaatgacttatactccttttggtatatgccagtaatgggattgctgggtcaaatggcatttctgtctttaggtcactgaggaatcgccacagtcttccacaatgaatagaccccttttaataatgaataggacaattagacagaagttataactggcagaagatcaacaaggaaa

SEQ ID NO: 11655 - DNA, 356 bp, Homo sapiens
aaaagatttttttttttttttgagatgaagtcttgttctgtcacccaggctggagtgcagtggtgcaatcttggatcactacagcctctgcctcccggattcaagcgattctcctgcctcagcctcctgagtagctggggttacagacacatgccaccatgcccagctaatttttatatttttagtagagacggggtttcaccatattggccaggctggtgttgaactcctgatctcaagtgatccgcctgcctcagcctcccaaagtgctgggattataggcatgagccactgcgcccatgcctataggattttttaaacagtgcggcatagagtacctaccacaaatggagttt

SEQ ID NO: 11656 - DNA, 373 bp, Homo sapiens
ttaaaattctgagaaagattgtgtagaattgatagtaattctctcacgagtgattgatagaattcatctgtgaaatcatccagatctggggttttgtttgcaggaaggcttgtaactacaaatttaatttttataatagatataggactatttagattggctatttattcttaagctttggtagtttatgtcactcaatgaatttgtctttttaatataagttgtcaaattcataggtataaagttgttcacaagaataacttatctcttcatagtgtctgcagatctatagtcatgacttttatttgtattagtggtaatttatattggttctctttgcctccctccagccgctccagctgtcccacacctc

SEQ ID NO: 11657 - DNA, 237 bp, Homo sapiens
agttgctctgatttgcattataatgttttttctttaactcctgggagcagggactatgtttcccattttttgaaacagaaatcatagtactaagatgaggtaggtacactatgaatccttgttcaatggaattaatttaaaatttaaaaaaaggttgaagagccatatccctttcataggaatgacagttcagaaattggggaaaaatttagaaggattaaaagtgagtgaatttct

SEQ ID NO: 11658 - DNA, 1485 bp, Homo sapiens
tccctgggactgcgtcactggtgcgcgccgcgggtcagggcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaacatggacttgggcctttggg

SEQ ID NO: 11659 - DNA, 561 bp, Homo sapiens
tccctgggactgcgtcactggtgcgcgccgcgggtcagggcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctgggtcatctcaagacattgggtttatgttgggtccacacccccgtcctcagcagtattgatgcctaac

SEQ ID NO: 11660 - DNA, 1354 bp, Homo sapiens
tccctgggactgcgtcactggtgcgcgccgcgggtcagggcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaaggctgctcggggttttttatttataaaacctctccccaccccccaccccccaacttcctgggttttctcattgtctttttgcatcagtactttgtattgggatattaaagagatttaacttgggtaacatggacttgggcctttggg

SEQ ID NO: 11661 - DNA, 1024 bp, Homo sapiens
gtcactcacagcttgtcctgaattccctctgcagccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaacatggacttgggcctttggg

SEQ ID NO: 11662 - DNA, 367 bp, Homo sapiens
gtctggccagattagtcctggtgtgttttcagcatgagagctcagaagggggcttgaggtgaggggcagtcctagaagggaggctgggaggaatgactgtgatgtgattgtcacctttttcccagcccattttcaccatattattgagcagctgcgtttccgccagagcagcgtggggaacatcttcttgtctgctggtgagtcctggctagctggcctgggttagggtgtatgatgatgtcgctaatggccactctggagaaggaattgggaactgagggccacagtattggagaggccactgaccgtgggaagttggggtgcaggacagctgtaggtggtggggcaggcagctactgcccccggg

SEQ ID NO: 11663 - DNA, 341 bp, Homo sapiens
cagggagcatgggcaaaggtctgggcaaaagcggtgggttatggtgaaagtgttttcttgccctcagattcttttcctgggcccactgatgcagctctctatggattgcccttgtgacctggcagatgggctgaaggttgtcctgggtgagtcttaaaggctgaagggaaaagtaggcacaggcagtccaggacattggggcagggagtcagcgggctcagggtgtgatctggacacgtgaaatgtcatctctctgggtgtgttttctcatcagtaaaatggaaacatagagctaggtggcctctaagggttgattgccaacgtccaaggagttccctggg

SEQ ID NO: 11664 - DNA, 1721 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtca

SEQ ID NO: 11665 - DNA, 1702 bp, Homo sapiens
cgaatggatagtaatttgtttgcatggggtagtatagagaagagatattaggttcacgacgatctgggagagggtgggatcagttaacattgttttgcgtgcacctcaggcttcctggctatgtgggactaaatagtaccggcattgtgggcctgtgcatactggaacttgcaacgggaccaacacgtgtaattgaagagtcagtgggaaatctagtctcttgaacaaacaacgtagaatttggaatataacggacggcctatgtgtaatatagagatagggcggcggggggtattgaatcataagttattagactgggtttgacagtaagttgaataatataactccgtctacgggaatggagttatagtaggtaaacaaaaaatagtaaggcaaagataacatcttgctcaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtca

SEQ ID NO: 11666 - DNA, 821 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtattttttgaacaacattttaaaaaacaaagcaggcctatgagtttaggatggattataaaattttattttttgtgtataatagttaatttaatattttttcttcaacaactaagcttttcattgagcttaagtttaaactcttaatatatattttgtcttcatatacatgaaattgactaaaatatttgtattcttgtaatattaccatggctaataaattaacttattaatagaatttaatagaacttgtcatgctgtccaggtgcgatggctcatgcctataatcccagcactttgagaggtcaaggcaggagaatggcttgagcccagaagtttgagacaggcttgggcaacatagggagacctcatc

SEQ ID NO: 11667 - DNA, 271 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccgtaagtattctaaaagatgacatgctttgcattattcata

SEQ ID NO: 11668 - DNA, 1868 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccagttgttgaaattacctccaacattcatgtcagtgattcaccactctccatgaagagctgaactggcacaagtggcaacgtatgttactgatgtaattggcacaaaactgttttcttattatctccttcactgaagccctatagccaaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtca

SEQ ID NO: 11669 - DNA, 1747 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggtaaggagcaattacagggcctctgcgttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtca

SEQ ID NO: 11670 - DNA, 1732 bp, Homo sapiens
atgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtca

SEQ ID NO: 11671 - DNA, 1450 bp, Homo sapiens
cagcaaaaattctaaattcatcgttttaagggaatgcaaatatatgaagcattttttaagtttatgtttatactccctaccttactccaagaagaatttaaggcagttcaaatcccacttaaatttatctatcagtcataaatgcaattctcagtcagtatgtattattatccataggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtca

SEQ ID NO: 11672 - DNA, 477 bp, Homo sapiens
tcagaggatccccttatttccttctttatgctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaaggaaaataagcttattttccttctttatggcaatacggtctttcttcagtggtcccatgaatgctttcttctcctccatggtctggaagcggccatggccaaacttggaggtggtgtcaatgaacttaaggtcaatct

SEQ ID NO: 11673 - DNA, 1798 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccagttgttgaaattacctccaacattcatgtcagtgattcaccactctccatgaagagctgaactggcacaagtggcaacgttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtca

SEQ ID NO: 11674 - DNA, 689 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaagggcttactcattcaagttccacctgaagcagcgacaccttctaaagacacaaagcaaacaaaaattattcataaggactagcatcttatcacaacgacaaaaatggagtgaaatctaaaacaaagcggtaaaccattcacacaaactgggaacaatacaaggaaccaggaataagaagggagaaaggcaatctctcttctaacacccttacatacgttttctgtaatctcttcccacgaaa

SEQ ID NO: 11675 - DNA, 394 bp, Homo sapiens
tgagcttctcttcagtaggacttgttctccgtggaagtaatgcatgccttatggagccacctatctagaggggtcttacttttgactctgccaggaatctataggtttacttggctcactcatattctggcagctgatgctggaagactcaaaacagctgagggctatcataactgggaatccttgggtatttctccctatctccaagagccctccccacaactcctcacagcatcatagctttgaagtagctgaactgacttcttacatgtaggatcaggattcctatggtgtatgtcaagagtgagagctaggtgaaagctctatcctttttataaagtcacctcagaagtcacatagcatcacttccaccaaatgaattggttggaactgt

SEQ ID NO: 11676 - DNA, 397 bp, Homo sapiens
tccaagtacagttgtcccttggtatccatgggaaattagttccagaacctccctctgatgacagaattcaaggatgttccagtccctggaacatggtatagtatttgcatataacctatgtgcatcctcccgtacacttgaatctctacactataatacctaatacaatgtaaatcattgttatactgtatgcttggggaataatgacaagaaaaaattgtacatgttcagtacagatgcagttaaataatttttctattcctggttggttgaattcatggatgtagaacccatagatatggagggctgacttgactgtatagtgcattggcttttcaaacagtaaatctgcaaaatctaacttgggtctgttatgcacaggattgccaaaaaaaaa

SEQ ID NO: 11677 - DNA, 1262 bp, Homo sapiens
tcatcttcaccatttgcaagggctcagttgggcagcattacatacaggcacattgttcgacctccagaattttttcacgctgcagaacggaaactctgtatccatttacatttttaactggttgaagatggaaaaagaaggctattttggggacacatgaaaatgacatgaaattcacatttcagtgtccagagatgaaattttattgactaaagcccagcccttcctgaatttatatacgacatgtgagatcatatccagctgtttagacacacacacaattaggtgattttaactgtgcttctctgagctacacccatcccttgttgcttaactgtaaaaatgtttatttaatttctacttgcaacaactcatgtatatggggcttctgttctgctggaagctctggatcctgtggcgtggggatgccgtcacagacttcacagtctgatagaggaggcagctgatataagtgccacctccatatgtcaagctgcatgtcagatggtacgctgggactagttgattctctgtgacttgccgcaaaagttccttgccacagtaatcccttgtttcccaagggtgatgtagatcatcctatgtgacagtaacaataggctaaaaacagccaaaggacttgaaagcgcttttttttcccatttttttttcctagagtgactgaataatgagggcaaaatgggtgtcagtgggcatgaaatgaatgaatgccatttgcaccaacctgttttagatgaggagggtgggacctggtgaggagtgaccactgggtgagcattctgtgtcaatggatttccagctcacattggcagcgatttgtacattatttcatcccattcctgtgtgatccatctgaaaagccgcgagacagagggacacacattcattttggtgtcaaagatctgggcttcagtcccagttcggccacatactagctgtgtggtcttgggcaggtttgctctctgggcctctgtcctgctctgtaaagcaggattcacaatagtgaccttgtcctttggaggaagtaggaggtgaagtccctgggcccagctcagcgtccacagcaaactcctatcaggcctgatcaccctggtgtgaacattaacccagaactagcttacttacttgctctgccaagaagcaagagttctgggttggtctgaactactctttggaaaaactacttttggcagatttcaaaccagttcctaaaatttccatgtattacatttagattaaagagg

SEQ ID NO: 11678 - DNA, 1502 bp, Homo sapiens
aggaatttaaaacaatactgaaactgatgggctttttaccatgaccatgagctggcgattctgatttaaacataatccaacacctcccccaacaaccttttgtctaattctgaacaattgctgcattattcttgacttttaataatatatgtaagcttcaaattcacacagactaattaccttttcataaacattacattctctatggaagttaattcaaataactcatattaatagttgcaaagccagcccctgacacccgtggactcagctacccatgtttcaagagcaagttcacaggattcggtatcagtggcactcactttggggtggctcgtcccccgagtcctgtggtacgatgtgttcctaagcttgaagaccagaccaaaaataaaggctggaagcacagtcattgtaaagacaaagaaatagaacctgggctattccatcctctcattctaccagaccacttgggagtttctatttatgtttctgacttttcaacaatgagatgttaatcaatcctgaagaactgaagaacaggactttgttgcaatgtctggaatttactgtgaaatgggattgttgtgaatttctgccaaattttatgtttaagatttatcctatttgtatatctgctgtttcaaccaaaagaaatttttcaaaattaacaggaataaaaagtgctctgcgaccagctttgagggaagatagaccaacaaatgcggctttgtctattgatcatgatgaatagggaaagatcagtatttacgaagtctgatcaatttacagaagactcaaaaccagaaactatagtttttattcattactgctacagaccactatgaaagtgtaacctttcccctttttcaaaataagcattagcgtcattaaattcattactccctgcccccctttttttattgctggcatcatatacacaaaattcagtaatagaaatgtttaactgtctgaaattattttctggccattatcatcatcattattatttatttcttaattattgaaataattttgttactatagaagaggggagtattttaaaaaatctactcctgagctgggcatggtggctcacgcctgtaatcccaacactttgggaggccgaggcgggtggatcacctgagtcatattttccatttagtaaaatgaacatctggctgctgtatgatgccttttgtgtaccatcacctaagccacaattacctgcaaggtaattcataccactacagcacggtgcaaaaacagggttggtttgggatggtgaaagtcagccatcttagtgtcaatcttgcatgcaaattctaatgaagaaaagccactaccagcaggtccacacacactcacaaagaactcataaattattttaatccaagcgttcaaagggatcctgggtcccaggaaccatcctgctgtttcatctcagtgagaggcaagatggttaaggaaaaacagctctagtttcctccatccccccaatt

SEQ ID NO: 11679 - DNA, 730 bp, Homo sapiens
agggagtaggcggagacagagaggctgtatttcagtgcagcctgccagacctcttctggaggaagactggacaaagggggtcacacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatgcccaaaatgctggccatcttctggttcaattccactaccatccagtttgatgcttgtctgctacagatgtttgccatccactccttatctggcatggaatccacagtgctgctggccatggcttttgaccgctatgtggccatctgtcacccactgcgccatgccacagtacttacgttgcctcgtgtcaccaaaattggtgtggctgctgtggtgcggggggctgcactgatggcaccccttcctgtcttcatcaagcagctgccttctgccgctcaatatcctttccattcctaatggctacacaagatgtcatgaagctggcctgtgatgatatccggg

SEQ ID NO: 11680 - DNA, 2444 bp, Homo sapiens
  misc_feature (1179)..(1179): n is a, c, g, or t
agggagtaggcggagacagagaggctgtatttcagtgcagcctgccagacctcttctggaggaagactggacaaagggggtcacacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctagcaagcggcgtgactctccgctgcccgtcatcttggccaatatctatctgctggttcctcctgtgctcaacccaattgtctatggagtgaagacaaaggagattcgacagcgcatccttcgacttttccatgtggccacacacgcttcagagccctaggtgtcagtgatcaaacttcttttccattcagagtcctctgattcagattttaatgttaacattttggaagacagtattcagaaaaaaaatttccttaataaaaatacaactcagatccttcaaatatgaaactggttggggaatctccattttttcaatattattttcttctttgttttcttgctacatataattattaataccctgactaggttgtggttggagggttattacttttcattttaccatgcagtccaaatctaaactgcttctactgatggtttacagcattctgagataagaatggtacatctagagaacatttgccaaaggcctaagcacggcaaaggaaaataaacacagaatataataaaatgagataatctagcttaaaactataacttcctcttcagaactcccaaccacattggatctcagaaaaatgctgtcttcaaaatgacttctacagagaagaaataatttttcctctggacactagcacttaaggggaagattggaagtaaagccttgaaaagagtacatttacctacgttaatgaaagttgacacactgttctgagagttttcacagcatatggaccctgtttttcctatttaattttcttatcaaccctttaattaggcaaagatattattagtaccctcattgtagccatgggaaaattgatgttcagtggggatcagtgaattaaatggggtcatacaagtataaaaattaaaaaaaaangacttcatgcccaatctcatatgatgtggaagaactgttagagagaccaacagggtagtgggttagagatttccagagtcttacattttctagaggaggtatttaatttcttctcactcatccagtgttgtatttaggaatttcctggcaacagaactcatggctttaatcccactagctattgcttattgtcctggtccaattgccaattacctgtgtcttggaagaagtgatttctaggttcaccattatggaagattcttattcagaaagtctgcatagggcttatagcaagttatttatttttaaaagttccataggtgattctgataggcagtgaggttagggagccaccagttatgatgggaagtatggaatggcaggtcttgaagataacattggccttttgagtgtgactcgtagctggaaagtgagggaatcttcaggaccatgctttatttggggctttgtgcagtatggaacagggactttgagaccaggaaagcaatctgacttaggcatgggaatcaggcatttttgcttctgaggggctattaccaagggttaataggtttcatcttcaacaggatatgacaacagtgttaaccaagaaactcaaattacaaatactaaaacatgtgatcatatatgtggtaagtttcattttctttttcaatcctcaggttccctgatatggattcctataacatgctttcatccccttttgtaatggatatcatatttggaaatgcctatttaatacttgtatttgctgctggactgtaagcccatgagggcactgtttattattgaatgtcatctctgttcatcattgactgctctttgctcatcattgaatcccccagcaaagtgcctagaacataatagtgcttatgcttgacaccggttatttttcatcaaacctgattccttctgtcctgaacacatagccaggcaattttccagccttctttgagttgggtattattaaattctggccattacttccaatgtgagtggaagtgacatgtgcaatttctatacctggctcataaaaccctcccatgtgcagcctttcatgttgacattaaatgtgacttgggaagctatgtgttacacagagtaaatcaccagaagcctggatttctgaaaaaactgtgcagagccaaacctctgtcatttgcaactcccacttgtatttgtacgaggcagttggataagtgaaaaataaagtactattgtgtcaagtctctgaaaatgatttt

SEQ ID NO: 11681 - DNA, 886 bp, Homo sapiens
agacccagttgcttgtgtcgagggagggagggagggaacagagggtgcgcgtgtgaaagctccgcccccagccctagctcctccttcccgcttcagcaggtccaggctctgcgccagtgcatccttctccaagagtgcgctgcctgggcccgcttgccctggagtgtaagtgctgggtaaataagaaccgcctggcgcaggctgtgtctactcttcacgccgccttctcagatcgggctgcatgtccccactccgtgtttacatctcgttcccgctccgggtctcggtgactggctcctcaagccggagacgcgtgtggtgcggcgcgatgcgggcgccagcgctgtgtgtgctggcggtgcgctgccttagtgcgggggaaagtggagggaacggtcctgcggggcgttctgtccaagaaaaaggactgcagcctcggggagccagggtcccctcgcagacgagctgccaacgccgcggagccatttctgttccaccctaggggaggagtagggggatatcttttaaaagtttaattgcaaaataagtaggttagtaaggccatttgtggttgctgtttcagtaacttcagcagtcaacggagagaagagtggaaaccttactggatgcggacaggagagccagttactgaaagcagatataacgcggatcctgtaaagagtggtgtgtatccaaaaaaaaaaaatctgtacaatgtattttaaaacttgtgtgcacaaaactgaagattttcttttttacctagtccaaatgccgtcctagcctgagtcctgctctttataaaaataaaataaaaagaatttgaagcttgtgaaagtattaagtgtagacattcaagtttatttgaaaccctaccaaaaaaaaa

SEQ ID NO: 11682 - DNA, 1684 bp, Homo sapiens
agacccagttgcttgtgtcgagggagggagggagggaacagagggtgcgcgtgtgaaagctccgcccccagccctagctcctccttcccgcttcagcaggtccaggctctgcgccagtgcatccttctccaagagtgcgctgcctgggcccgcttgccctggagttaacttcagcagtcaacggagagaagagtggaaaccttactggatgcggacaggagagccagttactgaaagcagatataacgcggatcctgtaaagagtgaattgtatatttccacatatgctggacaataggcagaaagtggagacccaaagaacttgtgatatgacggacataagaagcttcagttggcctcaaatgtcaaataatatccttcctgaataatcaagaatgtcaagcttttactttctacatcttggactgtactttgtaccaatctcaagtcccatatgatgcactttctaggtgaaaagtttttttttacagaccttaaatttttctttatttactttttagagtgatggtatatattagtttcaccacgttagtaattcatgctatataaatgataagccaaagtaagaaaaatagtgaaatgaattgcaaatctaactacattttttagtttccataatcaccacagaaattgctgttagtgcacttgatccaagaagagtcattcacaatctctcccttgcatgtttcccacctggatacagattcgtttagaggtcagcctctgacacaagatcagtcaatccaatgcctgccattatagttttggaaaggtgcctaaaaagacattaattttcctccaaatgacagaaactaaaggcaggtgaatgcggcagctattggtgtacttggatgctgaggatcaggcagagtggcttggtaatgagagagatgaatgagacagacacccagagagaaaggaaattaaggagcagtaaaagcattttacacccctccctccactctgccaaccctcagggctcatacacttttgctaactatatcacttatgtgctgttgtataccaaattacctcaaaactaagtggcttaacacaacagcatgtattatcccacaatttctgtgggctgagaatctagacagggagtagttggatcccctgtgtcagagtcttccacgagtttgcagtcaaagtcctgactgaggttgtggtttcatctgaaatttcaaatggggaaggatcctttcccaagttcactcatatggctgcagtaggattcagtttcctgcagactgttacactaatagcctcagtttctcaccacctgttggccagaggctgcactcagtttcttgtcacataagcttctcagctcacagcatggcatctgcctttgtcagagtgaaaagagaaaaagccaccaagaaggaagtcatggtctaatcttggaggagaatcttatgacttttgctgctctcttcttgttagaagccactacatccagcctctactcatgggaaggaaatgacacaaggtgtgggtatcaggaggcagaaatctttgagagctgttttaaaagcaacctaacacactgacatatttcagtccttaggcactgtaaaatagcccaaatatccctgcagtacatctgaatgcttgcctaaattctccaaaattcttttctattatttacaatcaaaac

SEQ ID NO: 11683 - DNA, 692 bp, Homo sapiens
agacccagttgcttgtgtcgagggagggagggagggaacagagggtgcgcgtgtgaaagctccgcccccagccctagctcctccttcccgcttcagcaggtccaggctctgcgccagtgcatccttctccaagagtgcgctgcctgggcccgcttgccctggagttaacttcagcagtcaacggagagaagagtggaaaccttactggatgcggacaggagagccagttactgaaagcagatataacgcggatcctgtaaagagtgaaaggagaagaccacttttagttgcctccctgctagcaccctgacttgctctgcttgaataagaatccaaggacacaagctaagacatttgcactgggtttagatctactgcgattcacaaaacacaaaagaactttcagtcagagggtgacacataatgattttagacaaaactcagtttcttctggtggaagctattcagattgtttggagagtgggaggaaaaaggagtgaagcatcgcttaacaacaaaagtaataatgcaggcagaatattaaatggagaagccagactttcaacacatagaaaagaaagctagttcagaatgttgagagacttgggagctgattgattgaaggtggcacttagaaggttgccctttttaaagataaaggctgatactgtgactctgtcccaggggacctg

SEQ ID NO: 11684 - DNA, 492 bp, Homo sapiens
tgtgttgactgtatatcaggcagttgctatagtcaggcattttaatagtttgcttcccaactctccaaatgtaaaacatagtaacaaaatttatacgccaccagcataaaaagaagaaacccagatgaagggaagtcaagtgagaaaaataagggtaatctacgcctgaattgaggccataaaatacttgtcttgagctgggggcactgctgtgcacctgtagtcccagctacttgggaggctgcagcagtaggatggcttgaggccaggatttctgtgctgtagggcactatgctgatggggtgtccacactaaattcagcactaatatggtgaaccccaaggagcagaggaccactaggttgcctcagaaaggctgaaccagcccaggtcagaaacagagcaggtcaaacttcaggtgctgatcagtagtgagactgtgcctatgaatagctactgcactccagcctagacaacaagagcttctctctca

SEQ ID NO: 11685 - DNA, 377 bp, Homo sapiens
aataatttatctggtaaactggaaagctacacagaaaaatatttagaattttcagcttacttgatgcctccaatgaaacctaagtagatttataatttaaatataaaaagaggaaaaaaaaaagaaacctagaatacattctatgagctaattttaagtgaaaaaaaaatcaggatacaaacttttctgtataattttaactatgtaacataagtgcacagccaaaatactgtaagaacaagcttttcaaggaactatactataaatggtcacaaaatctgggtagtaaaatcatgggctatttaaaaaattttcattatgcttttatacattttccaaatatcctaccacgagtatactttatctccatcatcaga

SEQ ID NO: 11686 - DNA, 330 bp, Homo sapiens
agatagcaaaataagagaagaaagaagtatgatcagatgtgagaaatgttacattcaaaatcataaacttggaaaaaggtaaattcccagatgggttcctttaggacagaaagaaaaaagtgcaattataaaatggggaataagtggatatatacaaatattatagcaattgatttgaaattacaaaaaaatgagtaggagctcagtaatttagcatgataattacttgagtgggcatgaccgaaacatgtgagtgaatagtttagaagaaagaggaatataattgaaatattatgaggtaattttcctgttgttctcagcaaacatcag

SEQ ID NO: 11687 - DNA, 353 bp, Homo sapiens
acccttgcatttctaggataaatcccacttggtcatggtatataatctttttaatatgctgttggatttgttgtgctgggattttgttgataatttttgcatctatattcataaggaatattggtacgtaatgtttccttgtgatgtcttcatctggttttggtatcagagtaatgctggctccgtagaattagttagaagatattcccccttctactttttagaagagcttgagaaggattgttgttgactcttctttatgtttgttggaattgtctagtgaaaccgtctggtcctggaattctctttttggggaagtttttgattactggtctaatttcctcactctttat

SEQ ID NO: 11688 - DNA, 372 bp, Homo sapiens
taatgccagaatgagttaagattttgggggcctattggaaaggcatgattgtagtttgcaatgtgagaaggacatgagatttggagaggccagaggtggaatggtatagttcagatatttgacccagcccaaatctcttgttgaattgtaatccccaatgctggaggtggggccttccttgtatgatgtgtttggaacatgcaggcaaattcctcatggcttggtgctgttttcatgatagtgagtgagttctcctgagatgtggtcatttaaaagtgtatggcacctccccccactctctatctctcttgctcctgctctgctatatgagacacctgttccccgtttgccttccaccatgattgaaagctt

SEQ ID NO: 11689 - DNA, 683 bp, Homo sapiens
gggaaattattaggcatcaacattacagtcctgatttggtttcttctgacattttttccctaatcttaaaataactgtaaagggcacccatttttctttagttaataatagaagactgcattgacacggttaaattcccattaccctcagttctttagcaatggaatgaatggctgggatcatcgcttaatggagtgtctggacctcagtagagcttaaattgagaaataaagtttatatttatatttttattgttaattccatttttcactgacatttttaaatcccatcacaattcacgtttgtctcaaaggtatttaaatttagaaatcatatcaagtgtgaaataaagaaaattgtatatagagagagagaacagaatctataaatatgcatgtttgtgtacatacatccatatacatacatatgtgtgtgcatgcagtaattttattctcctaaagcaatgcctctgccttccaccctcactgcacatgtcctagtcctgtgatgtccctggaactgagcacctgatttccttctctgcctcccacatgaacagggaatagaaatggaaaccacgctctgtggttgctgttgtgaaaatccatgttccccacaggctgagtttggcatcttacattctagttcccattgtaaaaaagcaagcaacaaacaaaaactac

SEQ ID NO: 11690 - DNA, 246 bp, Homo sapiens
cttctgcttcagcttctcaagtagctgggattacaggcacccaccacaacgctcggctaatttttgtattttaatagaaacggggtttcaccatgttggccaggctggcctcgaactcctgacctcaagttatctgcccacctcagcctcccaaagtgctgggattacaggcgtgagccactgcacccagccacattttttcattaatctttccaacctctgtgctaggtaccattattctaaatt

SEQ ID NO: 11691 - DNA, 667 bp, Homo sapiens
tgagagacggagtttcactctgtcccccaggctggagtgcagtagtgtgatctcggctcactgcaacttcttgtctccggggttcaagcgattctcctgcctcagcttccctagtagtggggactacaggcatgcaccaccatgtccagctaatttttgtattttttagtagagacggggtttcactatatgttggccaggctggtctcaaacttctgacctcaagtgatccactcaccttggcctcccaaagtgctgggattacagacgtgagccaccatgcccggccaggattttccactcttgaagggagtattttgttgtcacttcaactcgctgttttttttccagacaacctcaaatatgaccacactacagcctgtacacaacaagacagtttatcttgtccatggggtaagtgtatgcctgatctttttaattcagtacaatctctgaaggtgttaacactaatgttttacaagaatgtagaggcgactcggtgctatgaagcgtgttaaacaactcacacaattgctacaaaacaccagggaggggctttttgtgtttttaatttttaaaacatttttccttttcttgtgagccatagtaggcctagagagattactgggtttttataattaaacatttatttcggtgaaatcaaaaa

SEQ ID NO: 11692 - DNA, 2290 bp, Homo sapiens
ttgctcagtcactggggcaactacttttcacccaatgtcctctggaaaagaaagatctggagggtctttttcttcaaaataataaggagggggtgcagaagggtagggatgaacctctccctcctttgccgcttgagctttagctggcaaattggcaaataaacctgctctgtaacctcttctgttacttcgttttactctccttcctcctcatcatcagtgtgaaaaagttccaagggagaacgcaccagaccccacatttgtcccactgttaccctgatgcttctgagctccccttactcaccacagggatggctttaagagtacttgggtgtcctccagcttagttccacattctccgttgctccagtgacccttcaacctggattcgagcccccacaatggacgtcacttgccgagaccagttcagtcagggagaccctaacccagcagcactagaggaattaaagacatacacacagaaatatagaggtgtgaggtggaaaatcaggggtctcacagccttcagagctgagagccccaaccggagatttacccatgtatttattaacagcaagccagtcattagcattgtttctatagttattaaattaactaaaagtatcccttatgagaaatgaagggatgggccaagttaaaggaataggttgggctagttaactgcagcaggagcatgtccttaaggcacagatcgctcatgctattgtttgtggtttaagaatgcctttaagcggttttccgccctgggtgggccaggtattccttgccctcattcctgtaaacctgcaaccttccagcgtgggcgttatggccatcatgaaaatgtcacagtgctacagagattttgtttatggccagttttggggccagtttatggccagattttggggggcctgttcccaacaccaggagatgtgttgatttgctccagcaatgaaaccacatctggtacggcagctgcaattggagtcactacttagttaagctcatcataatccactgtcatcctccaagatccatctgtcttctgcacaggccaaatgggagagttgaacagggagatggtgggaatcaccacccctgtgtccttcaagtccttgatagtagcactaatctccatgttccctccagggattcaatattgtttttgatttactacttttctaggtacagccagctctaatggcttccatttggcgtttccaaccataatagcctttaccagtcaaggagccaatgtgggggttctgccagctgctaagtatgtctatgccaattatgcatcctggcacttggaaaatgaccacaggatgagtctggggacccactggacccgctgtaagttggacctgagctaaaactccattaattacctgacctcaggtgatccacccaccttggcctacctgtagggaccagccccacagggtcggtgggtttttctccccgtgtgcggagatgagagagcatagaaataaagacacaagacaaagagaaaagaaaagacacctgggcccaggggaccactaccaccaagacgcagagaccggtagtggtcccaaatgccaggctgcactgatatttattagatacaagacaaaggggcagggtaaggagtgtgagccatctccaatgataggtaaggccacgtgggtcatgtgtccactgaacagggggcccttccctgcctggcagccgaggcagagagagagggagagagagagacagcttacaccattatttctgcatatcagagacttttagtactttcactaattttctactgctatctaaaaggcagagccaggtgtacaggatggaacacgaaagcagactaggagcgtgaccactgaagcacagcatcacagggagacggttaggcccctggataactgcgggcaggcctgactgatgtcaggccctccacaagaggtggaggactagagtcttctctaaactcccccagggaaagggacactccctttcccggtctgctaagtagcaggtatttttccttggcactgacgctactgctagaccacggtctacttggcaacaggcgttttcccagatgctggcgttaccactagaccaaggagccctctggtggccctgtctgggcataacagaaggctcacactcatgtcttctggtcacttctcactatgtcccctcagctcctatatctgtatggcctggtttttcctaggttatgattatagagtgaggattattataatattggaataaagagtaattgctacaaact

SEQ ID NO: 11693 - DNA, 565 bp, Homo sapiens
tgcgcagacggggcggggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggcctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctggggaaa

SEQ ID NO: 11694 - DNA, 571 bp, Homo sapiens
gtttcaccgtgttggccaggctggtctcgaactcctggcctcaagtgatcctcccacctttgcttccgaaagtgttgggattacaggcgtgaggcaccatgcctggcctagaaaaccctttatctggagcttttaactttattcaagatcagaaaggttatgctaactttttagtaaaaattcaactcaaaaatgggtattttcctcaaaacttgcccttatgacctgcagatcctgtgccccagaaaccgtgagatgtctcaattcccatgcaggcaaaggaggggagcttcacactcagcagacctcatagctgttacaccaagtgggtacctctttacatcttatggtatttcccccaaaacaatgctgaaaatactgttctttggtagatatatttaaaacatacatttctcaaattcagatagctcttttttactatctctagtatttctattcctatatttgaaggggttttttttttcatttttttactcctggttcaagagtccagtatccattgccatattactatgatgaagatgaatctagtttattcataattaaaaat

SEQ ID NO: 11695 - DNA, 584 bp, Homo sapiens
ttcgtaacttgtcttctggacataggtttctctgtccggtggtctctacgaagtgggtaagggtgggagattgccattgacattcccgccctggacgggactctggtcctgtgggctttgacaggtcactgcattcctgccaggtcgacgttttgcgtttattgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggcctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagaatgtgaaaccaagggagagagtcaaaatacagacttgagtccgaagccattaatttcagagcaaacagtgattctggggaaa

SEQ ID NO: 11696 - DNA, 687 bp, Homo sapiens
gtttcaccgtgttggccaggctggtctcgaactcctggcctcaagtgatcctcccacctttgcttccgaaagtgttgggattacaggcgtgaggcaccatgcctggcctagaaaaccctttatctggagcttttaactttattcaagatcagaaaggttatgctaactttttagtaaaaattcaactcaaaaatgggtattttcctcaaaacttgcccttatgacctgcagatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtggcagctccagcaagtatcaatcccattgctggacatcacatccaacacccgtctccaattagtgggtgagtctctctttttttcctctccagattcctctcatatttctgggggttcaccagaaaattccagtaccaggtgagaggtctccctggtcaccaggtgaccgtggcctaccctctcaggggacgccgtcagaatgctcaccactttggccactgcagcctctgggggtct

SEQ ID NO: 11697 - DNA, 426 bp, Homo sapiens
ttcgtaacttgtcttctggacataggtttctctgtccggtggtctctacgaagtgggtaagggtgggagattgccattgacattcccgccctggacgggactctggtcctgtgggctttgacaggtcactgcattcctgccaggtcgacgttttgcgtttattggtgagattgaaatcccttcatttgtgttttcgccatttgtatttctttgtgatttgccagctcatatttttttccatgtatgttgaaaacatgcttctcaatttgtcttttgactctgattatggtgtttgattctggtttgggctttttcaaaatagaaaatttaaaatttttaggagtcaaatattttgccttaaggcattttgggctttgtgctgtgttttaaagggctttccccactccaagattatttttaaaataa

SEQ ID NO: 11698 - DNA, 354 bp, Homo sapiens
tttcgtttcagcagttggtcgagtgtgctacttgccgggtgtcttatcctctccccattttgctgtcgatgctgtcttttctgttactgtgttagagccctattttaatgaatgagcccaactctttgcaacacagcaaatattttccttgttgtttattggcttaattttaaaattgaaaataatatgcaatacttcttctaatgcaggcatgtcagaaatatataagtttcagaatttttgaatgccgttagagctttaggcacgcacgcacacccttttttctgtcatcaaagggaagctggtgtcgtttgactaacaccaggggcggcagggggcgctccactcgtcctc

SEQ ID NO: 11699 - DNA, 276 bp, Homo sapiens
tgcgcagacggggcggggcagccctttgtctgaaggtgctgcgggatgccgttccttcgcgcgtgaggctgcggctctgacggtgagtggggggcgcgtgtcgtcgccggccaggaccctctcccatcacggacaccggagccggtgcgtcctccacacgaatcgtggactcttccccgcgagcacgcactgcctcctgcgtttacgctggtcccctcccctcacggacgcgcggcggcctcctccccagggccaaggccgcgccctctcccccgt

SEQ ID NO: 11700 - DNA, 1711 bp, Homo sapiens
cagggccgagtgggcgacggagacggtcgctgttcagtgacgccccctgtcgggagcacgccgggccggacacagcgaagagcggctgcgcctcggacctcgcagcactcagcctcctaagtgggaggaataacctcacgcaagtcatcaaacaagaggacttcagtgttgcaacgaaggaagagaaagggcccctgagaaggcgacattcgcactgcagcggcgcagggaccagccaggcggctgagggcaaggtcgttcccagcagcgggaaccgcaagggcaaaaggctcggaggggggaacgagctcgagttccaggacggccgaagccagcgcaagtcgaggagggactgcggggccggcaggggtgtcctccacagggcgacggcggcaggagctcgggaaccgggactgcgagcggccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggcctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatggggctggagtgcagtgtagagacagagtcttgctgtgttgcccaagctggtctcaaactctgggattacagacatgagccaccacaccgggtgaaacttcagacaatagaagtaatacttttcagtgtaaatgagtaactatttctttagcctataggcttttattccatgaagatgaggcttatacattaaaaaaagaaagaactaaaacttctatcagtttaaaaaacacatagccagcttaggcaagatactgagaccccacactacaaaataaaattaaaaattagccagacatgatggtgcattcctgtaatcccagccacatggaggctgagacaggaggattccttgagcccaggaggttgaggttgcagtaagccatgatcacaccactgcactccagcctgggtgatagagtgagaccctgtctcaaaaaaaaacccacatagagtgactttctaaaatgagatatgttaaaaattgtattaaactgggccgggggtggtggctcatgcctgtaatctcagcactttgggaggccgaggcagatggaccacctgaggtcaggagtttgaaaccaagctggccaacatggtgaaaccccatctctactaaaaatacaaaaaattatctgggcatggtggcacatgcctgtaatcccagctacttgggaggctgaggcaggagaatcgcttgaacctgggaggcagaggttgcggtgagctgagatcgtgccattgcactccagcctgggcaacaagaacgaaactctgtctcaaaaaaattgtattaaactgaagacagtgaatttaaatttttttattaaaaaaactgttaaattctcactgtttcaatttgtcaatacacttaataaattcctctgaata

SEQ ID NO: 11701 - DNA, 1158 bp, Homo sapiens
cagggccgagtgggcgacggagacggtcgctgttcagtgacgccccctgtcgggagcacgccgggccggacacagcgaagagcggctgcgcctcggacctcgcagcactcagcctcctaagtgggaggaataacctcacgcaagtcatcaaacaagaggacttcagtgttgcaacgaaggaagagaaagggcccctgagaaggcgacattcgcactgcagcggcgcagggaccagccaggcggctgagggcaaggtcgttcccagcagcgggaaccgcaagggcaaaaggctcggaggggggaacgagctcgagttccaggacggccgaagccagcgcaagtcgaggagggactgcggggccggcaggggtgtcctccacagggcgacggcggcaggagctcgggaaccgggactgcgagcggccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggcctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcaggtgagtgaggagagctggcccctccctcactgagggctaaacaggtcctgagcaaagctgtggacctagttcatactgtgccgctcactggagtggcttccacctggagtaaaaccttatctggccttatctggcaaaggagtctatagactgggggttgctgaatcaggtggcagcccatggctggaagtgagcatagcagtgaatttcaacaagctgatgtgcagagccatgtagaggaagttagggcatggctgcagtgattctgtccctgaccagagggactggttagccagatttggtcctaataggacattcaggttttgagagttacctgatgatttagaaaataacaaagcatcctaaatgtggaaaggaagtgtctcaacctgacactt

SEQ ID NO: 11702 - DNA, 533 bp, Homo sapiens
ccgcgtcaagacgaaaacgagctgctttcgtttcagcagttggtcgagtgtgctacttgccgggtgtcttatcctctccccattttgctgtcgatgctgtcttttctgttactgtgttagagccctattttaatgaatgagcccaactctttgcaacacagcaaatattttccttgttgtttattggcttaattttaaaattgaaaataatatgcaatacttcttctaatgcaggcatgtcagaaatatataaaagtcatcccccccgacactctgccagtgtatgaagaggcaggagctgtgaacagtttcagaatttttgaatgccgttagagctttaggcacgcacgcacacccttttttctgtcatcaaagggaagctggtgtcgtttgactaacaccaggggcggcagggggcgctccactcgtcctccgccgggtgggtactcgcagatttttcagttcgtaacttgtcttctggacataggtttctctgtccggtggtctctacgaagtgggtaagggtgggagat

SEQ ID NO: 11703 - DNA, 254 bp, Homo sapiens
tgtgatttgccagctcatatttttttccatgtatgttgaaaacatgcttctcaatttgtcttttgactctgattatggtgtttgattctggtttgggctttttcaaaatagaaaatttaaaatttttaggagtcaaatattttgccttaaggcattttgggctttgtgctgtgttttaaagggctttccccactccaagattatttttaaaataaactcttgtttttctgtggtacttgtaaaatgttggatac

SEQ ID NO: 11704 - DNA, 1740 bp, Homo sapiens
tgcgcagacggggcggggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggcctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtggtacagccagctctaatggcttccatttggcgtttccaaccataatagcctttaccagtcaaggagccaatgtgggggttctgccagctgctaagtatgtctatgccaattatgcatcctggcacttggaaaatgaccacaggatgagtctggggacccactggacccgctgtaagttggacctgagctaaaactccattaattacctgacctcaggtgatccacccaccttggcctacctgtagggaccagccccacagggtcggtgggtttttctccccgtgtgcggagatgagagagcatagaaataaagacacaagacaaagagaaaagaaaagacacctgggcccaggggaccactaccaccaagacgcagagaccggtagtggtcccaaatgccaggctgcactgatatttattagatacaagacaaaggggcagggtaaggagtgtgagccatctccaatgataggtaaggccacgtgggtcatgtgtccactgaacagggggcccttccctgcctggcagccgaggcagagagagagggagagagagagacagcttacaccattatttctgcatatcagagacttttagtactttcactaattttctactgctatctaaaaggcagagccaggtgtacaggatggaacacgaaagcagactaggagcgtgaccactgaagcacagcatcacagggagacggttaggcccctggataactgcgggcaggcctgactgatgtcaggccctccacaagaggtggaggactagagtcttctctaaactcccccagggaaagggacactccctttcccggtctgctaagtagcaggtatttttccttggcactgacgctactgctagaccacggtctacttggcaacaggcgttttcccagatgctggcgttaccactagaccaaggagccctctggtggccctgtctgggcataacagaaggctcacactcatgtcttctggtcacttctcactatgtcccctcagctcctatatctgtatggcctggtttttcctaggttatgattatagagtgaggattattataatattggaataaagagtaattgctacaaact

SEQ ID NO: 11705 - DNA, 591 bp, Homo sapiens
tgcgcagacggggcggggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggtaagctgtccccagtgcttatgcagtgcccccagcccgagccctgtggttccttccgtgccccgtagagctcctaagagcagccagagcgtcaccacatgccctgaactccgcggccccttcccatcacccacctcagctcacagagccccccactgccaactgctcatgtcacatgtcacatgcacccactccccatcacagacatcaggatttggttttacctgcagcagcccctgtcgttcgccaagctgaccttcgaggatgtggctgtgctcctctcccaggatgaatgggaccgcctgtgccctgctcagaggggcctctacagaaatgtgatgatggaaacctatgggaatgtagtctcattgggtaagccaccttagcaggcctcgtctatgtatctgcgtatt

SEQ ID NO: 11706 - DNA, 540 bp, Homo sapiens
cagggccgagtgggcgacggagacggtcgctgttcagtgacgccccctgtcgggagcacgccgggccggacacagcgaagagcggctgcgcctcggacctcgcagcactcagcctcctaagtgggaggaataacctcacgcaagtcatcaaacaagaggacttcagtgttgcaacgaaggaagagaaagggcccctgagaaggcgacattcgcactgcagcggcgcagggaccagccaggcggctgagggcaaggtcgttcccagcagcgggaaccgcaagggcaaaaggctcggaggggggaacgagctcgagttccaggacggccgaagccagcgcaagtcgaggagggactgcggggccggcaggggtgtcctccacagggcgacggcggcaggagctcgggaaccgggactgcgagcgggtaaggctcggcgatgggctgtaacctccgcgcccggaagtgcggccggggagccggccgggcccattgcccagaggtgttcggcccctctagggatcgcggaggtctggctctcgg

SEQ ID NO: 11707 - DNA, 1370 bp, Homo sapiens
tgcgcagacggggcggggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggcctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatggggctggagtgcagtgtagagacagagtcttgctgtgttgcccaagctggtctcaaactctgggattacagacatgagccaccacaccgggtgaaacttcagacaatagaagtaatacttttcagtgtaaatgagtaactatttctttagcctataggcttttattccatgaagatgaggcttatacattaaaaaaagaaagaactaaaacttctatcagtttaaaaaacacatagccagcttaggcaagatactgagaccccacactacaaaataaaattaaaaattagccagacatgatggtgcattcctgtaatcccagccacatggaggctgagacaggaggattccttgagcccaggaggttgaggttgcagtaagccatgatcacaccactgcactccagcctgggtgatagagtgagaccctgtctcaaaaaaaaacccacatagagtgactttctaaaatgagatatgttaaaaattgtattaaactgggccgggggtggtggctcatgcctgtaatctcagcactttgggaggccgaggcagatggaccacctgaggtcaggagtttgaaaccaagctggccaacatggtgaaaccccatctctactaaaaatacaaaaaattatctgggcatggtggcacatgcctgtaatcccagctacttgggaggctgaggcaggagaatcgcttgaacctgggaggcagaggttgcggtgagctgagatcgtgccattgcactccagcctgggcaacaagaacgaaactctgtctcaaaaaaattgtattaaactgaagacagtgaatttaaatttttttattaaaaaaactgttaaattctcactgtttcaatttgtcaatacacttaataaattcctctgaata

SEQ ID NO: 11708 - DNA, 1803 bp, Homo sapiens
tgcgcagacggggcggggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggcctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtggtacagccagctctaatggcttccatttggcgtttccaaccataatagcctttaccagtcaaggagccaatgtgggggttctgccagctgctaagtatgtctatgccaattatgcatcctggcacttggaaaatgaccacaggatgagtctggggacccactggacccgctgtaagttggacctgagctaaaactccattaattacctgacctcaggtgatccacccaccttggcctacctgtagggaccagccccacagggtcggtgggtttttctccccgtgtgcggagatgagagagcatagaaataaagacacaagacaaagagaaaagaaaagacacctgggcccaggggaccactaccaccaagacgcagagaccggtagtggtcccaaatgccaggctgcactgatatttattagatacaagacaaaggggcagggtaaggagtgtgagccatctccaatgataggtaaggccacgtgggtcatgtgtccactgaacagggggcccttccctgcctggcagccgaggcagagagagagggagagagagagacagcttacaccattatttctgcatatcagagacttttagtactttcactaattttctactgctatctaaaaggcagagccaggtgtacaggatggaacacgaaagcagactaggagcgtgaccactgaagcacagcatcacagggagacggttaggcccctggataactgcgggcaggcctgactgatgtcaggccctccacaagaggtggaggactagagtcttctctaaactcccccagggaaagggacactccctttcccggtctgctaagtagcaggtatttttccttggcactgacgctactgctagaccacggtctacttggcaacaggcgttttcccagatgctggcgttaccactagaccaaggagccctctggtggccctgtctgggcataacagaaggctcacactcatgtcttctggtcacttctcactatgtcccctcagctcctatatctgtatggcctggtttttcctaggttatgattatagagtgaggattattataatattggaataaagagtaattgctacaaact

SEQ ID NO: 11709 - DNA, 811 bp, Homo sapiens
tgacgggaaaaaagttccttgggagtgagaagtgattactttttataaggtggttgagaaaggcctcactgataagatacttagagagctgaaggaggtggagagagagccatgcttacctccaaaggaacagcattccagagaggaatatgcatggcatgtttagaacagcagaaaaagccaatgaggctggagtgaagttcagcaaaggcaaaggtggagagagttgagatccaagagggagcagggagtcatgtcacgccctggtgaggatcataaggattgtcttttactctgaataaaatgggaatctttgcaggttgaacagaggactaatgagattcaacttagtgtttttaaaaagatctctctggcctctctgttgagaacagttcataggagaactctggtcaaaacaggggtcctggttataaggcagcactccaggcaaaacaagccagaggtatggatgagagaggcagctgcagatagaagtggtcacatgcaggatgtattttgaaagcagacctggccaggtgtggtggctcaggcctgtaattccagcactttgggaggccaaggcaggaggatcacttgagcccaggagttcaaggctagcctgggaaacatagcaagactctgtctctaaaaaaataaaaaattagctgggtttggtggtgcgtgcctgtagtcccagggacttgggaggctgaggtgagagaatcgctttagcctgggaagtcatggctgcagtgagctgtgatcacgccactgcactccagcctgggcaacagagcaagaccctgtctag

SEQ ID NO: 11710 - DNA, 737 bp, Homo sapiens
gcatctcctgcccctcttttcatccactgcatttcagccacactggtctttgccaacttaaaaacacaaagttcattccccacttaagacttgcaacagctcctccctctgcctgacatgatcaacccgagcttcccacacttgccattcagatctgagcttaaatgacacctacctgaagaggccttcctactctcccactcttccactctccattctaaggtcgcatcctcaccccacctaccaccagcacctccaccctgcttatattctcccaaagtacatcgcactacttaatattttttggcccaattattttttgtctcttctactagaatgttagaattacaagaaagagatcctgtctgttttattcactattgtatcttcagtactggaacagtacgtggcacttagatattcaattattttttactgaatgtttacaccactcctgagaagaataagcgtaagcgaaagaaggtgaagctggctgtcctgaaatactgtaaggtggatgagaatggcaaaataagtcgccttcatctagagtgctcttcagatgaatgtggtactggagcgtttatggccagccactttgacagacattattgtgacaaatgtctcattgcttcagcaaaccagaagacaattaattgtgtatgagttaataaaagacatgaactaacaaaacacatttactgaatgaataaatgtattaataattaaatgtcact

SEQ ID NO: 11711 - DNA, 384 bp, Homo sapiens
caatacagttatctttaagaatctgaaatgttctcatgagaaacagaaaatagagattctcttctctcttcaggaggtaggaccatgtacaaaggaaggaagttcaaaagagaaaaaagaatattcatctcagttaagagattagggaaagaatgagaaggaattgacatttcacttgctgagcttatattatatacaatatattatacagtttttatactcatttataccttactttccaatagttaatgttttccaaatacactattgtcattcttctagcaaaagcccagaaagtattttatagggagtcccatggaagataagatttgatatcctctgtggcttcttcaaatactaatagtttatgatttgctagctagc

SEQ ID NO: 11712 - DNA, 469 bp, Homo sapiens
ggaagcatttttctgcctcagcagagagaaaagtcaacaatggtctggtcatggtgaggaaaggaagtttcataaaagttcaacgaagaggagagacaggaaaaaagcaacaaaccacagtttctgaattgttggtctacaaaataaaagtctaatttttccatcagtcccaggtaaataccaacttagctgctgttgtaaactcaaattgctataggtaagtgaacatttttcagttatggtcatctataaaccagactcttgttgaaaagctggctaagattagctgaggtttataatctgcctaagtgaaattacttcatatacatgtttctaaatttccctaagaaattttgaaaaaggaatttaaaaatattaagatacagcaacaaaaagccatttcatttttgactgtattttaaggatattccaattttaaaatgttcaaattaaatgaagctttcaacac

SEQ ID NO: 11713 - DNA, 741 bp, Homo sapiens
catttaatatcatttattgtctagcaattgatttgaagatgaattatttgcatttccaggattaagtcattttatttgcaatggctcacatcaaatgactagctaaaaagagtttaaagaattaaaccaaagagattgttttgacaaaccttttccagcctattaaaattttcttagttttgtcctatcacatgtagagtagtacataagttattcggctctttattcgcaccactgcaacataaaagaaaaaacaaacagacactaaaacattgcaaagtcagcaatttgggggcttagaaatgtcctcacctcaacatatgtgcgttaataaataacagagggttatagtgccttttgggtgttttaaaaggaaaagaaaaaataaaatagcagaggacagagtaaattttcaccatgatagttaataaagtttcagtacaaaaccagttgttagcaatcaacaaacatgatattcttataataatatgatatttagaaactacatttatcatctttcttttgagacagagtctcactttgttgccgtggctgaagtgcagtggtgtgatctcagctcactgcaacctccatcccccggattcaagcgattcttgtgtctctgcctcctgagtagctgggataggagaatcgcttgaatctgggagtcagaggttgcattgagctaagatcgtgccactgcactccagattgggtgatggagcgagactccaactcaaa

SEQ ID NO: 11714 - DNA, 198 bp, Homo sapiens
ttccttagtgcctgtatctgggtcagtcagtccccttacctccctttccttggcttaaggtcctgctctgaacatgtccctttcaatattcatgtacagatattctggtggacacatggatgctgttttttcacatcctccctaacactggatattactgattttttttttcatttcagacattctgcatgtgttcca

SEQ ID NO: 11715 - DNA, 1866 bp, Homo sapiens
gtaaggaactgtagcttctctctgaaactgccgggaaagggaaaatctttttaaaatagacatcacacaaccaacagggtcccctaggttcaggcggggaggtgaggtcgagtgagaggaactgcttagcatacgcggggatgctcctcccatctcaccccaccgcgctaaggagaaggtcactttctctttaaatgcaaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaaaaaaaaaaaaacaaaaacaaaaaaaaacaaaaaaaaaaaaaaaagaaaaaaaaaaacacggagcaaaaaaaaaggacagagcacgggaggacacaaaaaggcagagccagagaaaacaaacacgacggagcccaacataaggaggaagagacaaagaacaagcacgacagacgcacacgaaaacaagacggcaccgacgggacgaaaacagagggccgagacggaacgagcggaagagacgccacacacaagaggggaggagaaaagaagaggaacaagaccgagaagagagaaggagaggaaaagaggagagagagagaaaaagagaagagaaagagagacctggaagaggaaagaagaaggaacagagagagagatctcctccgacgcgatcattaaggagaagagtataatagaagcagattaggtaataagagtgatgtagtatcacgagtgagacaagaaacaaagagaaaagagataagacaaatcagataaagatgaatcgtgtattcaggaaagaaaagcaagggggaggggcgggagaggaagagaagcggaaggaggagaagaagaaggaagtgcgcggagagaagcgagaggaccgcacaagcgaagcgagggaggcgcggcggaccggaaggggcagcacagcgaggcgagggcaggggggaggccacgcaggggagagggcaggggcagaaggcgaggggggcgggaaggggagccccggcgcgcaggcgagggacgagaagacgcaggggaggagcaggacggcagaggagagaagacaa

SEQ ID NO: 11716 - DNA, 982 bp, Homo sapiens
caggcagaaggggaattaggttgggccttagaaggtccttcaagtgtacatccacgatcccagcagcagacactggcatctggctctgcccctaccgtatagatgaggtgacaagctggaaggtcccagggcccttccttggtgcagctctcagggatttctgggtgaagggctaactttgcccctggctatctttgtggggttgcttccctcctaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaa

SEQ ID NO: 11717 - DNA, 1241 bp, Homo sapiens
  misc_feature (24)..(24): n is a, c, g, or t
  misc_feature (71)..(71): n is a, c, g, or t
cctatgtttaagtgtgatctcccnagggcagatgggataaaaccctgaatgcagataaatgctcctgccanagtctccctctgccttccggggtgagagagggcaggcggggactgcaacctcagtccacagacggcccgagaccctcgtccccggccctttgcacaggtgagggaactaaacctgtgcaagatgggagaccggggtgggaggaaggactggtccaaagcgccacgatccttgacgggcacagccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaaaaaaaaaaaaacaaaaacaaaaaaaaacaaaaaaaaaaaaaaaagaaaaaaaaaaacacggagcaaaaaaaaaggacagagcacgggaggacacaaaaaggcagagccagagaaaacaaacacgacggagcccaacataaggaggaagagacaaagaacaagcacgacagacgcacacgaaaacaagacggcaccgacgggacgaaaacagagggccgagacggaacgagcggaagagacgccacacacaagaggggaggagaaaagaagaggaacaagaccgagaagagagaaggagaggaaaagaggagagagagagaaaaagagaagagaaagagagacctggaagaggaaagaagaaggaacagagagagagatctcctccgacgcgatcattaaggagaagagtataatagaagcagattaggtaataagagtgatgtagtatcacgagtgagacaagaaacaaagagaaaagagataagacaaatcagataaagatgaatcgtgtattcaggaaagaaaagcaagggggaggggcgggagaggaagagaagcggaaggaggagaagaagaaggaagtgcgcggagagaagcgagaggaccgcacaagcgaagcgagggaggcgcggcggaccggaaggggcagcacagcgaggcgagggcaggggggaggccacgcaggggagagggcaggggcagaaggcgaggggggcgggaaggggagccccggcgcgcaggcgagggacgagaagacgcaggggaggagcaggacggcagaggagagaagacaa

SEQ ID NO: 11718 - DNA, 325 bp, Homo sapiens
ggtgcctgactgccccctaccctgtgatcatggtcatgtccaccccacccagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcggtgagtcctgggggctggtttcagcgggtgtgtggatagggctgtagggcccagtccatggggcatggctgggaccatggttccagggttccagggttccaggact

SEQ ID NO: 11719 - DNA, 1072 bp, Homo sapiens
gtaaggaactgtagcttctctctgaaactgccgggaaagggaaaatctttttaaaatagacatcacacaaccaacagggtcccctaggttcaggcggggaggtgaggtcgagtgagaggaactgcttagcatacgcggggatgctcctcccatctcaccccaccgcgctaaggagaaggtcactttctctttaaatgcaaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaa

SEQ ID NO: 11720 - DNA, 1645 bp, Homo sapiens
gtaaggaactgtagcttctctctgaaactgccgggaaagggaaaatctttttaaaatagacatcacacaaccaacagggtcccctaggttcaggcggggaggtgaggtcgagtgagaggaactgcttagcatacgcggggatgctcctcccatctcaccccaccgcgctaaggagaaggtcactttctctttaaatgcaaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatgtatcctttccaaggaacccgtctatgtgtgtgtgttcctgagaggtcagtttcctcctctccagccctccaggagtattcacacacaaccaacttccccacctcttgcagtcctgtcagatttagccacagactgcccaaacccaggtacaggaatttagaatttccccaaaattagaagaaaagtggttgtaggggatgttttactactgatcaaaatctttgtgagtactttagctgacatcaatcatagcaaagcttgtccgatgtcctcctatcctttcagcattgaacaattatttttactaatttacactaccacctcacctggtcctcagtcagaaacagcgcgagtgcgcgcgcacacaccccagtgtgtctgacctgcacgatctggatgaagagagagggggtgagagagggcaggcggggactgcaacctcagtccacagacggcccgagaccctcgtccccggccctttgcacaggtgagggaactaaacctgtgcaagatgggagaccggggtgggaggaaggactggtccaaagcgccacgatccttgacgggcacagccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaa

SEQ ID NO: 11721 - DNA, 787 bp, Homo sapiens
  misc_feature (580)..(580): n is a, c, g, or t
  misc_feature (590)..(590): n is a, c, g, or t
caggcagaaggggaattaggttgggccttagaaggtccttcaagtgtacatccacgatcccagcagcagacactggcatctggctctgcccctaccgtatagatgaggtgacaagctggaaggtcccagggcccttccttggtgcagctctcagggatttctgggtgaagggctaactttgcccctggctatctttgtggggttgcttccctcctaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgctggaaganctcataattntatccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaa

SEQ ID NO: 11722 - DNA, 594 bp, Homo sapiens
tcttgttgcccaggctggagtgcaatggcatgatctcagctcaccgcaacctctgtctcctgggttcaagcgattctcctgcctcagcctcctgggtagctgggattacaggtatgcaccaccctgcccggctaattttgtatttttagtagagatggggtttctccatgttggtcaggctggtctcgaactcccgacctcaggtgatccacctgccttggcctcccaaagtgctgggattacaggcatgagccaccgcccctggcagcagtttctcgtgtctgaatgtttagttgaatccagaaagacaccctggtgggtgctgtatactaaatctacttcacctatttactttgtactccaatccttgttggtgtgaccctctggtttaaagaactggccaaacttccatcaatttagtaaatattcattgaatgtttattatgtgttgggtaatgctatggatacagcattgaagaaaacagacaaaatcccttccttctgggagtttatattctagtaggagaagacagacaataaattaatagtcagtgatcagaatttagataatactgtattttgaattcagagtct

SEQ ID NO: 11723 - DNA, 246 bp, Homo sapiens
tatttgtagccatcataattgtcaaaattggaatccattcagtgctaaaaaaatcctgtttcatgtctattgagaacacaaacgcaagggggcatactgtaattattttaattaataagcatatgtggttatttattgagcataaaatttgggtgtgatacaactataagccctccatctgtgtaatgtaatgtgccctgaggatgtgatatagtgatattaataactgggaactcatttttattt

SEQ ID NO: 11724 - DNA, 803 bp, Homo sapiens
  misc_feature (776)..(776): n is a, c, g, or t
agatcgtgccactgcactccaccgtgggcaacagagggagactccatctcaaaacagaaagaaattatttataaatattattgaccgggcgcggtggctcacgcctgtaatcccaacgctgtgggaggctgaggcaggcagatcacctgaggtcaggagttcaagaccagcctagccaacatggtgaaaccccatctctactaaaaatacaaaaattagctgggcatggtggcaggcacctgtattcttagctactcaggaggctgaggcaggagaatcgcttgaacccaggagatggaaattgcagtgagccaagattttgccactgcactccagcctgagcagcagagtgagacttagtctcaaaaaaaaaagtatgtatatataattatatacaaatatttatttgaaaacctttacaatagcaaagttatttttttaacttgttgaaaactagtaggcagcatttaaaaggttctgtacaatgaatgaaaaagatactgtcatcactgggcattccagagtactagggataagataatatactacacatcttctagaaagtaaaagcaggttacacataaaggaacaaggattagaatgacctcagactttcaacagcaatgttgaatgccagcaaacaatgaagaagtgcctttataatcttaaaagaataatttcaaaaattatttgggctgggcacagtggctcgagggggggcccgggtaccccaatttcgccctattagttgagtccgtatttaccattccactggnccgtcgttttaccacgtcgtgactggt

SEQ ID NO: 11725 - DNA, 691 bp, Homo sapiens
gtctcctgtataaacttcattgaggtagtgtcttgttcactgccatattcctagggacaagtaaagttccctgtatattgtaggagctaagtgttgaatgaatgaatggtggctgctattattgcttcaccttcaccctccaagagtaatctccccattctggtttatagtttctgtgctcactgcttgtgataatcgtaagtatatattgttgagaacagtgcctgttttctctttccctgaaaacacatactttgacgttggctgacatagttcactcagctgttcctaaccactgatccctctgtatcacaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttt

SEQ ID NO: 11726 - DNA, 429 bp, Homo sapiens
ggatgggggcgcctgttgcttctccagggggttgcgcacgccgtccgccccttggagggattgggaggcccacgccctgctgcgagaagggcgcgttctagctcctgagggactccaagctctaccagacctgcctgaagtgttttaaagcacattttctttttgaaaagaaacctgttgctgcagcttagcgcatctgttctctgtgtccatgtgggaggagaatcctggcaccctcatctagtgaaatgttacctaaagcaaagatttgcagccctgggttgttttttccgtcctgcagtgtttttagttacttcgaaggaatttgcaaaactgttacagataatttcagttctttttgattttttgtaaatgttgtgcctattttttatggagtgataaagcctgctgagtgcgtttcgtgctgtg

SEQ ID NO: 11727 - DNA, 1725 bp, Homo sapiens
tgcggagggcggggctgaggcgcctgagcggggcacaaccctcctagaggcgggacggtttcctgccaatcactgctggtttgccctccccctggtgttggcccggctgactcggggtaggggaggtcggggagggggcgataaaatggcgcagggggcggagtgaggcgcagtcgttcgcccaggctttggcccggcttccggaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttt

SEQ ID NO: 11728 - DNA, 1635 bp, Homo sapiens
tgcggagggcggggctgaggcgcctgagcggggcacaaccctcctagaggcgggacggtttcctgccaatcactgctggtttgccctccccctggtgttggcccggctgactcggggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttt

SEQ ID NO: 11729 - DNA, 1628 bp, Homo sapiens
ggatgggggcgcctgttgcttctccagggggttgcgcacgccgtccgccccttggagggattgggaggcccacgccctgctgcgagaagggcgcgttctagctcctgaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttt

SEQ ID NO: 11730 - DNA, 2044 bp, Homo sapiens
tgtgttctcgaattttgttttatttcaaaagtaatacatttttgttttgtgttaaagtgtaaactgaatattcagacattttacataatatacatttgttttgtttgtatgttgtagatatcattccatgatagtacatacagatctacttcattgtgtttttaaataattgaaaagtactccatagcacaaacataccatgatttactgaacagttctcttggtaatagacatttaggttgcctccaggatttggctactttgaacatccatgtatatatatatgaagttctagaagtgaaattgctgggtcaaatggtgtagtcaaattactcttcacaaaatatcgtactgacttaacgcttttactgatagtgtgtgaatgctcgtttctccacatcctcaccaatccagattatcatggcatcttaattatcaccattttgataggcaaaagtatctcatcgttctaacgtgtatttccatgtttctggtaaggttaaatatcttaaaattatttcttatgctacaagtcacagtgcaaagattttgaaatactagaacattacccacatatagtggactggagttggtataaggttattttctcttcctcagtgaaattgtctcttatttctccagaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttt

SEQ ID NO: 11731 - DNA, 603 bp, Homo sapiens
cccttctcccagctcctatcccttaggactgccccgccccctagaacctccccgtcaggatctccgtccctcagccgctcacagcctcctcccagcgcccatcgcgcttgagctgcccactacctctagactgccctcccgggctggcgtcccacggagtctcagccgcgcaccccttcctcgcgttaccctccttccggacagcaccccctcccttctccaaacctggagtgagaagggcagggtggggaagagggtagggcatccgtgaagttcaatggggcggcacccaccccatcatgactggcggcaaggatgtgggctggtccctcggttaaggacggggccatttctcccttcccactttgggtggaagttgaggcgggtcccgggaccctccggaaaccccctgcctcctgaagggctggggaatgtgctcagtctctttctcctctccccttattaaaaccgcccaaccctggtgttgtgacacacacttgtagtcccagtctcttcagaggccgaggcaagatgatggcttgagcccaggagtttgagaccagcctggccaatataacgagatgccttctctacaaaaaaaaa

SEQ ID NO: 11732 - DNA, 853 bp, Homo sapiens
cggattcggctggttccgggttgagaggctgcgctggaccgaagcggtggctgctaagctcgcggggcctcaaggacgagctgctgtgctccatctgcctgagcatctaccaggacccggtgagcctgggctgcgagcactacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggtaagtgccacccgccggggccctccccggctgacc

SEQ ID NO: 11733 - DNA, 3262 bp, Homo sapiens
cccttctcccagctcctatcccttaggactgccccgccccctagaacctccccgtcaggatctccgtccctcagccgctcacagcctcctcccagcgcccatcgcgcttgagctgcccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcactacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctagaccccttgtcagacttggcatctatctcagttaggatcctgctgcagaaaacaagagccacttgtagctggtttaattagacaaggatttactacctggcccctggtggcttgcaaaattgttggaagagctggagaagcagactctgctgaatttccaggaactcccagcgccagattcatcatgtctgttgtgaccaggaaagctgcccccatctgcaggaagccactatgccagaaagctgctgactgcagaactaggctccctctgccacggtccgtgccagccaatagatgtcctgaggcctgcccctctcccacttcactcagttcccaaatctaaatttttacaagagattctgtttgggggaacttaagtcagatccagaaccttggctgcaagggagtctgggaaatgtcatttccctagaaggaagttagggtgggtggagcaagccccacctgcggcgaatggcctagcatacaatagcgaagacctctgaaaagtgagaagcccacatgtgagtttgacatgccgcttgacaatgtcaatcccaataggtggcatcagaatgaacccactagatgactgagcc

SEQ ID NO: 11734 - DNA, 3317 bp, Homo sapiens
cccttctcccagctcctatcccttaggactgccccgccccctagaacctccccgtcaggatctccgtccctcagccgctcacagcctcctcccagcgcccatcgcgcttgagctgcccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcactacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctagaccccttgtcagacttggcatctatctcagttaggatcctgctgcagaaaacaagagccacttgtagctggtttaattagacaaggatttactacctggcccctggtggcttgcaaaattgttggaagagctggagaagcagactctgctgaatttccaggaactcccagcgccagattcatcatgtctgttgtgaccaggaaagctgcccccatctgcaggaagccactatgccagaaagctgctgactgcagaactaggctccctctgccacggtccgtgccagccaatagatgtcctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttacagatgtcagtaaaaaaaaaccattc

SEQ ID NO: 11735 - DNA, 3570 bp, Homo sapiens
cccttctcccagctcctatcccttaggactgccccgccccctagaacctccccgtcaggatctccgtccctcagccgctcacagcctcctcccagcgcccatcgcgcttgagctgcccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcactacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctagaccccttgtcagacttggcatctatctcagttaggatcctgctgcagaaaacaagagccacttgtagctggtttaattagacaaggatttactacctggcccctggtggcttgcaaaattgttggaagagctggagaagcagactctgctgaatttccaggaactcccagcgccagattcatcatgtctgttgtgaccaggaaagctgcccccatctgcaggaagccactatgccagaaagctgctgactgcagaactaggctccctctgccacggtccgtgccagccaatagatgtcctgaggcctgcccctctcccacttcactcagttcccaaatctaaatttttacaagagattctgtttgggggaacttaagtcagatccagaaccttggctgcaagggagtctgggaaatgtcatttccctagaaggaagttagggtgggtggagcaagccccacctgcgtttttctgccacagcatccaatcgtgaagaactcgggagagggtggagtccacatctagggttgtcctgccccttggctctatccctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttacagatgtcagtaaaaaaaaaccattc

SEQ ID NO: 11736 - DNA, 3349 bp, Homo sapiens
cggattcggctggttccgggttgagaggctgcgctggaccgaagcggtggctgctaagctcgcggggcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcactacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctagaccccttgtcagacttggcatctatctcagttaggatcctgctgcagaaaacaagagccacttgtagctggtttaattagacaaggatttactacctggcccctggtggcttgcaaaattgttggaagagctggagaagcagactctgctgaatttccaggaactcccagcgccagattcatcatgtctgttgtgaccaggaaagctgcccccatctgcaggaagccactatgccagaaagctgctgactgcagaactaggctccctctgccacggtccgtgccagccaatagatgtcctgaggcctgcccctctcccacttcactcagttcccaaatctaaatttttacaagagattctgtttgggggaacttaagtcagatccagaaccttggctgcaagggagtctgggaaatgtcatttccctagaaggaagttagggtgggtggagcaagccccacctgcgtttttctgccacagcatccaatcgtgaagaactcgggagagggtggagtccacatctagggttgtcctgccccttggctctatccctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttacagatgtcagtaaaaaaaaaccattc

SEQ ID NO: 11737 - DNA, 2213 bp, Homo sapiens
gccggaaggcagatctcaccgcctgcttccctctgcagcggtagcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgt

SEQ ID NO: 11738 - DNA, 2373 bp, Homo sapiens
gccggaaggcagatctcaccgcctgcttccctctgcagcggtagcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatca

SEQ ID NO: 11739 - DNA, 2351 bp, Homo sapiens
  misc_feature (10)..(10): n is a, c, g, or t
gggtggcganttcggcacgaggcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatca

SEQ ID NO: 11740 - DNA, 3234 bp, Homo sapiens
gccggaaggcagatctcaccgcctgcttccctctgcagcggtagcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatcaaatgttgtgttcatgtttggggaaaatataatttgcagaaacctatgaagtagagcaaagatgctttaaaaagataagtttttttgaactaaattttttttagttctaataatgcacataggatattagtacatcgtacacgtgctaggaaaaaacagcttcagtgtctttgtttaatgtgttgaaactcatctttttaaatcttgaaaaaccaattgtttacttgaaacttgaaagtagcatatttttctgttttttggttgtttgttcatttgtattagcacaatttaatgtaattcctggtttggaggcagcaagacctatgagcaagaactatttacttgaccctcgtttttttctcttgttcttgtgtggtctgaaatctaaaactagactttattatgatagatttcctataagccaatttctaataacaaatagatttattatttaatctgtaccttctatcttctcataattcgtggtcttacagccttccaaaataactccagttgggcacccatgagctaggatcaaactttctttatatactttatatattttacattatttctgatttttaaagcaaatgattgccattatgattacactcaacctaaatagttatgaacagtttcagaacaatgaaaaattacaatactatgtgatagtattgtaactatttttctattttagtcatatgtcgcttatatcctaccagaactcttaaatctataatattcgatatattctacaaactgctttattgtagaagccatatttatgtttattttataatgttttctagtgtcaaactgtactgtggagaaaagaaatgttagatctgtgtaaaaaactgca

SEQ ID NO: 11741 - DNA, 2183 bp, Homo sapiens
gccggaaggcagatctcaccgcctgcttccctctgcagcggtagcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacagactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatca

SEQ ID NO: 11742 - DNA, 2037 bp, Homo sapiens
tcaatagcttgacaaatccctttatcgtgaggagaaatgatctgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatca

SEQ ID NO: 11743 - DNA, 905 bp, Homo sapiens
  misc_feature (10)..(10): n is a, c, g, or t
gggtggcganttcggcacgaggcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagctttgtgcagtcagctttcaaggcttttgaccttgttcctctgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatca

SEQ ID NO: 11744 - DNA, 871 bp, Homo sapiens
gtttcttacaaagtcttatgagaagagcaaaggataactttgtttatagttcagacattggaaaaatctttgggaaaaataatgcatattgtctcatggggtgttttgtctaagtcaatagatgtgttccatgcttaagtctctggagttctcttttttttcctatttagtcctcttcttaaggttatattttcattgtcacttgggtcaatggggggagcatttaaactgtgctttgggaataatcccttgacctggatttttttcccccttattttccagtgatcctgatgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatca

SEQ ID NO: 11745 - DNA, 664 bp, Homo sapiens
  misc_feature (39)..(40): n is a, c, g, or t
  misc_feature (42)..(43): n is a, c, g, or t
gaaagagatgaatgggacgggaccgggggccgactgganngnngaaagaattcaaggatttcaggtactggccacttaactagatgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatca

SEQ ID NO: 11746 - DNA, 9296 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaacgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgcccgtgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttttactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatgtgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgcctacgggggcacctgccaggacccggacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacagcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaacgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgtagtcaatgagtgcgactcacgaccctgcctgctaggcggcacctgtcaggacggtcgcggtctccacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgatgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggatggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacaaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagactcggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtga

SEQ ID NO: 11747 - DNA, 7120 bp, Homo sapiens
tccctcgacctgcagtgtggtcccccttgcaggtacaagtgcgactgtgaccctgggtggagtgggaccaactgtgacatcaacaacaacgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgtagtcaatgagtgcgactcacgaccctgcctgctaggcggcacctgtcaggacggtcgcggtctccacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgatgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggatggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacaaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagactcggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtga

SEQ ID NO: 11748 - DNA, 7178 bp, Homo sapiens
ggtttgggtgatatctgaactgctctttatgtcttccagcatacctccacagggtacagtgactgggatgactacgcatacagtgatgtggatcttagagatcaccatagtgagacaacacttgttgccgtaagtctgacagttgggaccgctgaagcccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgtagtcaatgagtgcgactcacgaccctgcctgctaggcggcacctgtcaggacggtcgcggtctccacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgatgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggatggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacaaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagactcggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtga

SEQ ID NO: 11749 - DNA, 9583 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaacgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgcccgtgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttttactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatgtgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgcctacgggggcacctgccaggacccggacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacagcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaacgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgtagtcaatgagtgcgactcacgaccctgcctgctaggcggcacctgtcaggacggtcgcggtctccacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgatgtggccgcattcctgggagcgctcgcctcgctgggcagcctcaacatcccctacaagatcgaggccgtgcagactcagtgcgagtgcagcgatttgaagttgactaatcctccttccttaaaggagaaaaaagtaaaagccgtctccagatagagtcggctggtgcaggagagaatttagcgatagtttgcaattctgattaatcgcgtagaaaatgaccttattttggagggcgggatggaggagagtgggtgaggaggcgcccggacgcggagccagtccgccgccccccggccaccagcctgctgcgtagccgctgcctgatgtccgggcacctgcccctggcccccgtgcccgcaggtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggatggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacaaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagactcggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtga

SEQ ID NO: 11750 - DNA, 4501 bp, Homo sapiens
agagagagagagaagaattgatcggtgtcatgtgaagtgttgaagtttgtatcttgaaaatccctctaaatcctttgtcttaacagctcagtgcgagtgcagcgatttgaagttgactaatcctccttccttaaaggagaaaaaagtaaaagccgtctccagatagagtcggctggtgcaggagagaatttagcgatagtttgcaattctgattaatcgcgtagaaaatgaccttattttggagggcgggatggaggagagtgggtgaggaggcgcccggacgcggagccagtccgccgccccccggccaccagcctgctgcgtagccgctgcctgatgtccgggcacctgcccctggcccccgtgcccgcaggtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggatggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacaaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagactcggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtga

SEQ ID NO: 11751 - DNA, 6149 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaacgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgcccgtgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttttactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatgtgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgcctacgggggcacctgccaggacccggacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacagcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaacgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgtagtcaatgagtgcgactcacgaccctgcctgctaggcggcacctgtcaggacggtcgcggtctccacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgatgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgcctgcactggccgccgccgtgaacaatgtgatgcacaaacccgaaaggatcctctag

SEQ ID NO: 11752 - DNA, 5906 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaacgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgcccgtgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttttactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatgtgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgcctacgggggcacctgccaggacccggacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacagcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaacgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgtagtcaatgagtgcgactcacgaccctgcctgctaggcggcacctgtcaggacggtcgcggtctccacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgatgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctggtaagggtgccagcagccagggcttccctagccccgtggcccacctgcctctctcccctaagccccgaggctggggtacagttgatactctggaaacttagaattgggggtgagagctttcatccttggggtgtttcccattcagagtagacgtgggggggtcctggagtcctcctgttcttccaccaaccccttcctggggtgataccgcagggccactctgtccctgtaaattactcttttctgaaaccttcttgagacatggaa

SEQ ID NO: 11753 - DNA, 2864 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaacgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgcccgtgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttttactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatgtgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgcctacgggggcacctgccaggacccggacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacagcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaacgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgacactttctgatacaatgtaaacaaggaacagctat

SEQ ID NO: 11754 - DNA, 1020 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaacgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggtagtgctgcccgctggccggggtgcacgagcccctccccggctgccaggcccagggggtgggaacggggcgcctggtgtaggggcagccctgggagggcccatggcggggagttgggaaggcgggatggcgagttccccagactgcgtgtggtgtcggggggacgcgtctggagcggggtgtgcgctgggaggaggcttgcacagggtccaggtgccagcccgtgtctctggagtttcccggaactcacattcgagctgtaggacgccctgcctccc

SEQ ID NO: 11755 - DNA, 2255 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaacgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgcccgtgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttttactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatgtgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgcctacgggggcacctgccaggacccggacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacagcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacggcgtcagcctctaccttcccgcctcggctagggtcctcggaaaccgga

SEQ ID NO: 11756 - DNA, 530 bp, Homo sapiens
aacggggccaactgcacggactgcgtggacagctacacgtgcacctgccccgcaggcttcagcgggatccactgtgagaacaacacgcctgactgcacagagaggtgtgcggggctcgagtgaggccgtggaagggaacgggcggtgcgggccacacgcagtagctggcagcctggcacaccatgcaggcgtccgcctaggccggctgggcacttagcgctggctgcattgagtccagacattgttcattgtaccgacctgtccctcctgagagggccattgtgacctcctcctgtgtcccgcaccaggagcgccggtagtctgtcctgaagaactggtgcgcttccttctattagacaacgagaactctgtccgttcttgtttcctttttgccgtgtttgccaggaagctcatttggtaaacgtcagtctcgtccctggtttctgacgtaattacctcccgtgttaccaggacggtttctggtttctccctcatttactttaaccaccctatgcccacgcgtttggtaa

SEQ ID NO: 11757 - DNA, 393 bp, Homo sapiens
ctaaggctcttcattaaaaatagtaatatgaataggaattactttgtttgtttgtttttcgtttgtttgccaccacacccggctaattttttatttttagtaaagatggggtttttccatgctggtcaggctggtctcgaactcgtgaccttaggttatccgcccaccttggcctcccaaagtgctgggattacaggcgtgagccaccgcgcccagcctatgagtaggaattactttgtggtgctgttatacatgtgaaaaaggatttgcgagactttgggagtctgaggtggaataatcacttgaggctaggaattcgagatgagcctgggcaacatagacccggtctctacaacaacagcaacaaaatgagctgggcatggtggtacacac

SEQ ID NO: 11758 - DNA, 427 bp, Homo sapiens
attcactgcattcataaggcctttctctagtgtggattttgtgatgcttaagaagtgtttgtttggagatgaaggctttcccacagtcactgcattcataagccctttctccagtgtgaattctctggtgtcgcatgtagtcagacgagcggataaatgatttcccacatatgatgcacacataaggcttttctccagtatgaattctctggtgctcaagaagtctttttttgtgaatgaaggccttcccacattctttgcactcataaggcctttctcccgtgtggattctatggtgatcaagaagtgactgtttgtatatgaaggatttcccacattcactgcactgataagccccttctccagtgtgaactctctggtgtcgaatgcggtcataggaatgaataaaagatttcccacattccat

SEQ ID NO: 11759 - DNA, 601 bp, Homo sapiens
ctggaaaaaggaacaggataatcgtgattggctcaagccttagggtgggcatggctccctgacaagggagagaggaaaaagctgttgagtgaagaagactgctcaagtttccccatctgtataatgggaggagtaagggctgtcgtgaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaaaaaaaa

SEQ ID NO: 11760 - DNA, 231 bp, Homo sapiens
ctctgattggagaagatgttctttctcccactgcaattagggacaattgctgctgctggcagcaattatcttgtgaccagagtggaagccaatttaagaaaaatgaagacacagaatagagcagagctgaggtcccagagaaatggagcaaggcactgtctgcgctccggacttcagttgtgtttgatcacatccctgtttattgtttatgccagttttagtggtgttttc

SEQ ID NO: 11761 - DNA, 607 bp, Homo sapiens
aaacacaaattctgcccaatttggggttaatcaaaggagacagagcaccttccctgttagaaagagttagccagtcttgcttaatgaagtttggctttgaggaatgggcaaatccctcagtttgttcctaatgctaagtgaaacattgtagtcaagaatccaggactggacagaccttagaaaaataaaaatcaagcaattattgagtcttggaagaagcgtgagcatttcaatgcttcattgcaatgtcttgactaggaaatatagagttaggaaaacttttcacttagtcattataggaatcaaagcaggtgcgtggtaagggaggtgtccttaattttgatgaattttctgacacacaactcaaagactgacagtgtcctatatgttaatcgtcacgcctatgacttaaaatatttgaatcttaaagaaataatctactagatggccaaaactactgtttagaatttttgatttacctctaaaggggatgtaaagagtaactccgtgcatgactaacattcaaggaacaaaaactatttacttccttgaatacacttataagcctcagtataattttgttatcctaaacagtgcaaaaaaaaaa

SEQ ID NO: 11762 - DNA, 788 bp, Homo sapiens
tggaaacctcagggccaaaggctcctgtctgtccttttccgccctaaatcttctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtggacaaaagccaacaaagacccaaatcctctgtccttgggagcttgaggagagtttaccagttcgagttcccactgggtctgagaactttgcctttaaaatccattcctggcccctgcctaccacttcctgctctggggaatagagttgagggggccacctccatcaccttaatgtgactctccccacagaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacgg

SEQ ID NO: 11763 - DNA, 784 bp, Homo sapiens
ggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacgg

SEQ ID NO: 11764 - DNA, 744 bp, Homo sapiens
ccgcctgctggtggattagcatagactactctaatttttgattttgtgtattacttgcaagttcactgtcactagttaggaagacagtggaaccttgtggctgattttcatacgttcagccaaggtcagcacacatttctctcccctgcgtctctttgacacctgatgtggtggccatgccttcgctgggcccctgccgcctcggggtttcttgtcttcctggctgctactgctccatggtggcctctccctccttacccttcccttaacgctgtgtcctcagagccttgctggggcctctcctccttcgcttttgaacgctcagcgacttgcagggcttctgctgtcgtctctctcctgggggcgcctcaattgatagctgagccttgggcctctctggatgtctcctagtgcctcgagtttccaacactacaccacgttcagcccccaccctgcgttcctttccttcgagtctgaaaacatcatccatctagatgtctgagccaggaaatcggacagttgttcttggttcgtccgtctcttcctcctgcctgtttctcactaattgtgtcctcagtcctgccacccacagtaccctggcctctgtccatctgcagctcacccaggcgacctttcccggggcatttctgcctgtgcaccccccaagcacgatgcttctgggaaaagtccagacctttaagagtcccagctttgcctcctgcttgcttctctgcctgtctgcct

SEQ ID NO: 11765 - DNA, 1137 bp, Homo sapiens
aaagagcaagccccgaactcctgatcacgtcagcgggagtctcagctgggtgccgggctgtcttgaacacttgctaattttgggtgttgtttttcctcctctggctgggctataagtttcctttttcttttctttctttctctttgttttttcttttgaaacagggtctctctacagtggctcgatcatagctcactgcagcctcgaactcctgcactcaagcgatcctctcgcctctcgagtcgctgggactacaggcgcgagccaccgcgccccacaaattctgtttaaaaaaaaaattgtagagatgggatctcactgtgttgccaggctggtctcaaattcaaattcctgggcataatgggttttccagtcttggcctcccaaagtactgtgattatacctgtgagccaccacatctggcctgaagtttccttttggaacttaaaagagtggatcttattgcagtagctcttctctaaataattcaatagcagatctctgggattccctttttattattatccataggcactggaagacaagatggatctttttaaatgctagaagttttaaccagttcttaacatgtctttgttgaggcaccttccagaatataagataaaacaactccagtttctgttatagtgacttgaatctcagagtcaagagcccagtgtcaaagaaaattggctttgactttttgtaatctaggagcacgagtctgtgaggtgtttattcaaagagttaaagagcctgttttgtaccaaacaataaactgtaaaaagaaaaaaaaaagtgaattttgagagtatgaaagaatagccaacagatccatatatctggaaaaaacgtattatagtataggtataagagaatgacacagatctagaaaacattgttttagtggattttatttcagctgaggaagataggctggtctcagtggagacttaaaccttttttttttttttttttttgagacagggtctcattcctcattctgctgcccaagctggaatgcagtgataccatcatagttcactgcagcctcaaactctgggttcaagcagtccgctcgcctcagcctcccaagtaactggaactataggcatgtgccaccatgcctggctaatt

SEQ ID NO: 11766 - DNA, 809 bp, Homo sapiens
agggaagcagtagcgacatctgggcatcacttggcagcgtggctttggctgctcagcacgtgcttgctagagaatccctgatggctgttatggcttacacatttaaccacttccctttggtacatgtgtagaggtgctgggtaagcatcttgtcaactttaacacagctgacaaagttatgacaccaagaatgcttagactttgcagttttccccgaactccggctgatcctgttaaaatgtctctccttacagagagctgatttgtgcccccaaattttctcatctcagcaggcagggtctctttgccagaaaaaagaaaaatctgttgtcatccagatactctgatttagcattatctgagaggaaggcatgtttcctatctggtttgttgctgattttccagttggtttccgtgggacggagccatggagaaggatgcaggaggatagctggagacacttgcatttttaagctcctctcctccaatgcaaagccttaaaatgcgtgggattttccctcttgttaaggctgcagtcttcatgcctcttctcagttggagagtgataaagtttgaacaaatccctttatttatgttggaagtatctgagtgtgaaaatccttttctgcccttaaaattactcgatccgtttttttctcttttttaaatgatcagtttaatacatgcccattatagtgaaattagaaattacaaacaagaaccagaaggaaaagttgctgaagttccactaccgtgtatccctgcagatgcgttcccatacagatgaacagatataaatctgtattttg

SEQ ID NO: 11767 - DNA, 465 bp, Homo sapiens
gaagggcctgacctgggctcgcagctgactcagcatttgtgctgtttctctctttcctccttccccagttctgagaccgctgctgagccagaaactcgaatgctagcaagggaggggatgggtgaggaatgataataatgatgagcttcctgagcatctgccctgagccaggccctgtgctgaaggctgtgtggggatgagctcactgagtcttcacaacagccctgtgtggtcccagtgttacaatgcccattttacagatgggaaaactgaggccccactcataaccctcatgccagagaaaggaatccaacaggggcttggaactgcagtcagaggctgcccctcagtggccatttcttctcggggggacttgtcacccttatggtttccatgaccctggccaccctccatagatatataccgtgagcccataggaaaacattttctcgtagccaccttttt

SEQ ID NO: 11768 - DNA, 383 bp, Homo sapiens
gggtttcaccatgttggccaagccaatctcgaacccctgatctgaggtgatccacccacctgggcctcccaaggtgctgggattatacacatgagccaccacacctgaccaacatatgtattatttcacacatttttgtgtgtatgtggtgagaacacttaaaatctattcttttagcaattttccagaatgtgatacactggtattaactgtagttaccatattgcacagtagatcttgaacttattcctcctaaccgaaattttgtgtcctttgacccacatctctccacccccaagccccccacccctggtaagctctgcttttaagagttaactttttaagattctacatataaaggagaacaatatttaaggcagata

SEQ ID NO: 11769 - DNA, 324 bp, Homo sapiens
gcatcaaatgcaagtgcatgttttattggcctgaataagtggagacacggagcaggaatctgaaagggcttcctaccttctttgatcagtgttgcattgttgtgtcaaggccatgccttttacacacctcatctacacaccttggcaagggaaacttagttgtgcaatgccagaaggtaacagggtaatttttcagcattgctgacaaactgggaaagaaccagaaaacaacaacatgaggatataaagcaacaactggaaccactcactttaccaagaatgtctgagatgttttttaatccttgcaatgcaaaactctgtcta

SEQ ID NO: 11770 - DNA, 497 bp, Homo sapiens
cctttttcccagatgaatagaaccctcagattcatttcagctgtatagaatgaaaaagccttccagctagcagctgtcagtaaactgttctttttttctgtatagacaatataacatcaataaagatagtttgtgaaaacaggagggaggaaaaaaaaaacaaaaatcctgacaagtactttatttttatttttacacatgtccttctatgtccatctgtcagtatctttatgtgcttgaaatctttttatgaatacatttttacattatattttcattataaacacaatatttcattagatactccatgtaagagttgcagcctttgtggtcagtgtgtgtatggttcagtgagggatggtgctgacctccccagaaaagacttctgcttctttagatattccagtattggattaggattgctcattctgggtataccagagccttacagggtgcctagaaatgggagccagtgccgggagaaggccaaaaaaaaa

SEQ ID NO: 11771 - DNA, 479 bp, Homo sapiens
ctctttctactctggtagaattcagattattatttaagaaatgggggaggggggaagtagcttttgttcacatacgcataagcctgagaacacaagtgttttaataacgcatgtagctttctatagaaatagagctatctttgtttggattgctgcaaataatcaacttgtatagggacatcctagaagtggaatttaccctatgatccgaataccaggaaaaaatcattttagaaatggttttgtaattaagactcagatgcttggaatatttgaggggtaagtgagtaaaagaaaggcataaggctctgcccactctcaaatatgctttttaaaaacatgtgatttgaggctgggcacagtggctcagctggtaatcccaacactttgggaggctgaggcaaaaggattgcttgagctcaggagtttgagattagactgggcaacatagtgagacctccatctctgccaaaaaaaaa

SEQ ID NO: 11772 - DNA, 412 bp, Homo sapiens
gttcttaggcatgggcaagcaactttgaatcagataggaatggacaccagttcatactgtagctattttttctacttaaaattgtcttacctgtgcttatatattgattgattttttaatttattatttgttattctctttttagagttggggtcttgctctgtctcccaggttggagtgcactggcagaatcatagctcactgcacccttgaactgggctcaagagatccttccaccccactctctcagttcactgggattacagacctgaggcacagcactcagctctatagctttgatttagtcttagagaaacacagaaaaactagagtgatttcaaatccattgttctattttctcttgaaaggacacatttttctgcacagtgtattctaaatagttgatgatgca

SEQ ID NO: 11773 - DNA, 698 bp, Homo sapiens
cagggcattggtggcttgcggatgtagtcccagctactcatgaggctgaggttggagaatcgcttgagcccaggaagcggagtctgcagtgagctgaggttgcgccactccagcctgggtgacagagtgagaccctgtccaaaaaataaaattaaattaaaaaataagatcaaggctagttctagacaaaattaaattgttctttctagtattttctcctttcagcatctctctttcttcaactcttcctctgttctgtgcagcctcctctcaagtcctcactgccatctcttccaaacactttctgatgactgccaacggtgaacaaacccgtgcaccctaggagaaggcattacccctctgtggcagaggtggtcgtgttcatcaactcctccaggtttctcctgcatttcccacctcccctgtactcacatcgggcccggggactggttgatgggctgtgaacagaagtgacaggtgtcgctttggtctaaggcagttgggaacagtttgtgagttctctttactctctttatcatcactgtgactggaagggaaacaccgagatggcgaagttgcaagatggaagctgcctggatctgtgagctgctgttagagaaaagctactaaggagtttcctggcttgcattacactgtcccgtgaaagaaaaaataaacctcggtcttaagctgttgaa

SEQ ID NO: 11774 - DNA, 514 bp, Homo sapiens
gcgcacactgagtactgctggtggtgccgaggtcactggtggggtgaggaagaaggagaagggggatgccagtgccctctcatgtaagatttgtagtattttaaacagaacctattttggagccatgcatccagtcacctgctaggagacctactagtagagaccccaagtcatctctttttgtcaaagaacaagataagagcacagccagcctatattttaaaagacatttaggccgggcatggtggctcatgcctgtaaccccagcactttcggaggccgaggcaggcggatcacctgaggtcaggagttcaagaccagcctggccaacttggaaaaaccccatctctactaaaaacacaaaaattagtcaggcgtggtggtgcacacctgtagtcctggctgcttgggaggcttaggcaggagaatcacttgaacccaggaggcagaggtttcagtgagccaagattgcaccactgcactccagcctgggcaacagagtgagactccatct

SEQ ID NO: 11775 - DNA, 728 bp, Homo sapiens
gctgggattacaagcgtgcaccacctcacccagccctacttgaccttcagtatattgttttcttcttctcttgcgttgtcccctcccaccccttctgctcatgaacttctacttaggcttgaagatgtgattccaatgttacttcctttggaaatgagccaaaacttccagtggattaacccaggaagagataactacttcctcttctgtggtcttgtatttcattcagacctccatcatagcacttacatggctaagactgattgttttacctatggatgtttcattaaaccagaaggcagaagaaacatacttggctgcaaggcttgtttctttgcttcctcttgagtacttctgcaaaaatattactggactctttgtgcatgttgtgaccaacactgtcattctgataggaggaaaatgtgattaattccacagtttaatttgaaatgctatattaaaagatttgggctagaattctcttctggtcttcgttttgatagtgaagtatactggcacatacttaaaagttagctcaatcaaaatgcttcataaatcccagctttcgttactcttcaaggaaaagatgccagtttacttctctttaaataatgtgtttagtctgggcatggtggctcatgcctataatcccaacactttgggaggccgaggcaggaggattgcttgaagccaggagttcaataccagactagacaactaaaaccctg

SEQ ID NO: 11776 - DNA, 2922 bp, Homo sapiens
  misc_feature (2718)..(2718): n is a, c, g, or t
  misc_feature (2741)..(2741): n is a, c, g, or t
  misc_feature (2744)..(2744): n is a, c, g, or t
  misc_feature (2749)..(2749): n is a, c, g, or t
  misc_feature (2868)..(2868): n is a, c, g, or t
  misc_feature (2874)..(2874): n is a, c, g, or t
gcgcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaagctccagcacccgagcgccgaggtccgcgagtgcgcctgcgcagggctggcccggctggtgcagcagcggccggcactcccgggcctggcgcgacgagacgccgtgcgccgcctcgggccgctgctgctagaccccagcctggccgtcagggagactgcagccggcgcgctgagaaatcccagtgcttgtggaggttttgaagtttgtgatgacatggtgactaaggatatcatgacccctctggttgcgctgctaaaagagtgtagtgctggactggattcaaatgagatgtctctgcaggagaaaaaagatcagaacagaaattctattgagaacatagccaatgagactgtgaacgtgctgtggaatatatgtgaatgcagtagtagagcagtgtctatattcaacaaagaagggtgtttggagattgtgttaaagtatttaagtaggttccctaccaatgttgacctggctatttcagtagcatattgtttgcagacagtgactgaggataacccagagctgctgaagtctttcagtgctacagcattgaacatgctggaatcagcactgctttctcccgtcagttccatggaatctcttctattgaagacattggtagcaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccgcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccaggttatttggggcccacgtgtgttccgctttctcacattcccacgagaaggttcagctcaccgcagtttaggacccagccgcaaagccgggctcattctggggagtgattttcttcacggaggctcgatacgcaggcgccgtctgcaggcaacagcttctgctgaagggcagccgtatttagaacagcggaaatgtgcagggtgagagtaagggggacacggctgaagggagcctatgggtggaatgagtgacggagaggcacaattttggaatgaagaagatatagatcatttgcggaaattacaaatgtggttgccaagagacagggtctcgctatgttgcccaagctggaggaagtggaattcctgagagcagcagagatcgagcttggggttacggtttgctgcgtctgagcaaaaggacctgcgagaacaggccgagcgtggctcacgcctataatcccagcaccttgggagaccgaggcgggcagatcacttgaggtcaggagttcnaggccagcctggtcaacatggcnaanccccntctctattaaaaatacaaaaattagctaggcatggtggtgcatgcctgtaatcccagctactcgggaggctgaggcaagagaatcgcttgaacccgggaggcggaggttgcagtgagcngagatngcgccactgcactccagcctgggtgacagagctgagactccatctcaa

SEQ ID NO: 11777 - DNA, 2051 bp, Homo sapiens
agcggagtgtttggagagatcactcaggcagctggaggaagggagagcacaggggcctggcagcaggaggaccagtcaggaggctgccgaaggacgatgaaggctgagttggaaggaggcaatcatgtcctctcatgcttacctgtgttcgtgatgtctcgggaagcgtaaattgatggtgtttcaaagaaatcaaaatgtggatagaaccacttttcccctcatatgagcaaactcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtctcaaattcctgacctcgggtgatccgcctgccctggcctcccagggtgctgggattgcgggcgtgagccaccgtgcctggccagaaactcttttttaagcgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttgtatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaagttttgtgtcttacaaaatcttttttaagataccaaataaagggttattagtagaaaatg

SEQ ID NO: 11778 - DNA, 3208 bp, Homo sapiens
gcgcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaagaaatcccagtgcttgtggaggttttgaagtttgtgatgacatggtgactaaggatatcatgacccctctggttgcgctgctaaaagagtgtagtgctggactggattcaaatgagatgtctctgcaggagaaaaaagatcagaacagaaattctattgagaacatagccaatgagactgtgaacgtgctgtggaatatatgtgaatgcagtagtagagcagtgtctatattcaacaaagaagggtgtttggagattgtgttaaagtatttaagtaggttccctaccaatgttgacctggctatttcagtagcatattgtttgcagacagtgactgaggataacccagagctgctgaagtctttcagtgctacagcattgaacatgctggaatcagcactgctttctcccgtcagttccatggaatctcttctattgaagacattggtagcaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccgcccactgacaaggaactgagagagactatagcattgctgacagcccaacagactgctctggaaattattgtcaacatgtgctgcaatgaaggtttgttaacatttacatttagacattttccccctgagccaagagggaaactcccgtggagattttcttaactattccagttctgcgtggtttgcccgcttcccagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaaggtaatccattttcattctaggcttaccgtggagcatgggaaaagcttaagcaaggtattcattttgtgtacaaaagaagcaagctcacacttccaggttgtagatggtggtaagatctgagacaaagctgagcctaacagtactggaaataggcgaaaaggtcattctatatgaagcctaaccatttcacttaggagtaatatgttggaattatgtaagggaatcgtgttaaatgactactctttaacctttgctttactgcctcttttaaatctagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtctcaaattcctgacctcgggtgatccgcctgccctggcctcccagggtgctgggattgcgggcgtgagccaccgtgcctggccagaaactcttttttaagcgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttgtatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaagttttgtgtcttacaaaatcttttttaagataccaaataaagggttattagtagaaaatg

SEQ ID NO: 11779 - DNA, 1664 bp, Homo sapiens
  misc_feature (1461)..(1461): n is a, c, g, or t
  misc_feature (1484)..(1484): n is a, c, g, or t
  misc_feature (1487)..(1487): n is a, c, g, or t
  misc_feature (1492)..(1492): n is a, c, g, or t
agcggagtgtttggagagatcactcaggcagctggaggaagggagagcacaggggcctggcagcaggaggaccagtcaggaggctgccgaaggacgatgaaggctgagttggaaggaggcaatcatgtcctctcatgcttacctgtgttcgtgatgtctcgggaagcgtaaattgatggtgtttcaaagaaatcaaaatgtggatagaaccacttttcccctcatatgagcaaactcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtgtggctcacgcctataatcccagcaccttgggagaccgaggcgggcagatcacttgaggtcaggagttcnaggccagcctggtcaacatggcnaanccccntctctattaaaaatacaaaaattagctaggcatggtggtgcatgcctgtaatcccagctactcgggaggctgaggcagaagaatctgagccaagataacaccattgcactccagcctgggcgacagagtgagactatctcaaaaataaataaatcacctaaataaatagtca

SEQ ID NO: 11780 - DNA, 1375 bp, Homo sapiens
agcggagtgtttggagagatcactcaggcagctggaggaagggagagcacaggggcctggcagcaggaggaccagtcaggaggctgccgaaggacgatgaaggctgagttggaaggaggcaatcatgtcctctcatgcttacctgtgttcgtgatgtctcgggaagcgtaaattgatggtgtttcaaagaaatcaaaatgtggatagaaccacttttcccctcatatgagcaaactcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtatgttgtcggatcctcaggcac

SEQ ID NO: 11781 - DNA, 535 bp, Homo sapiens
attatccactacatggtagaagcaccatataatgtaatggtttctacagtctttaattatgataatacagatatctcaaagtaagttcttaccttgtatagactcagccaatttttttaaaaccacacaatcctatttatactttcaaagcctttttcttaccattaatattaaaaaggaattggactctctttagtgtgtgtacatctggaatgaaagtcttcatcaaattaaatggagcccctttgatattagataacagtgccgacatgagcagggttcaccttagttcagaattaccagctctgtctgggagaactggaatacatattaatagtaacttacctgccaggagtttatgtcactcttaaaatcctgtagcctatagaggagattcctgtcagtccggttttcacatgctgatagaattaattgagtttaacattataaatactgtcctcttctcttttaacagtgcatgactcctgatcagctgatgacattatgcaaagcaggcattcatagtagtaatgtc

SEQ ID NO: 11782 - DNA, 419 bp, Homo sapiens
aacagagtaagaccctgtctaaaaaatgatgataaattttagaaaacacaaaaaacagttcaccttgtgattctttgctaactgccatagataccttgtatttacagatatttccagtcagaacgtgaagcttaggctaaaagttaatactgaattctgatgggcaacttctggagaatcagatggcattgtttcacttcctttccagaatgaacactattcagtgcagagccctcttctgtctccagagtcttgtgtccctcctggatgtggagcacctgggaggagccgcagcccttcagacgcttgcacagcatctgtcacagctgcttttttctcaaccaggtatttagactttattgcgaaagactacgcagacggaacagaattttgaaggggcaggaatttggattttgtaa

SEQ ID NO: 11783 - DNA, 2727 bp, Homo sapiens
gcgcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaagaaatcccagtgcttgtggaggttttgaagtttgtgatgacatggtgactaaggatatcatgacccctctggttgcgctgctaaaagagtgtagtgctggactggattcaaatgagatgtctctgcaggagaaaaaagatcagaacagaaattctattgagaacatagccaatgagactgtgaacgtgctgtggaatatatgtgaatgcagtagtagagcagtgtctatattcaacaaagaagggtgtttggagattgtgttaaagtatttaagtaggttccctaccaatgttgacctggctatttcagtagcatattgtttgcagacagtgactgaggataacccagagctgctgaagtctttcagtgctacagcattgaacatgctggaatcagcactgctttctcccgtcagttccatggaatctcttctattgaagacattggtagcaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccgcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtggcgtgagccaccgtgcctggccagaaactcttttttaagcgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttgtatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaagttttgtgtcttacaaaatcttttttaagataccaaataaagggttattagtagaaaatg

SEQ ID NO: 11784 - DNA, 766 bp, Homo sapiens
acgccttgtatacgattgcggcgtggcgcgcgtgtgcatatatgtactgtgatcatgaccgtttcctagcgcactaggcacgatcctggtcatgactagtggtacggatcctgatcaagtctgccagtggccgtccggaaagggatgggattaaagcgacatgcacatcgagtcctgtcgtcaaacatctgtatctatcgagatagaagtccagcgcgagatcgcatatcggtcttctacctggatgcttgctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttgtatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaagttttgtgtcttacaaaatcttttttaagataccaaataaagggttattagtagaaaatg

SEQ ID NO: 11785 - DNA, 1769 bp, Homo sapiens
tggcacgaggactggaaattattgccaacatgtgctgcattttagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtctcaaattcctgacctcgggtgatccgcctgccctggcctcccagggtgctgggattgcgggcgtgagccaccgtgcctggccagaaactcttttttaagcgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttgtatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaagttttgtgtcttacaaaatcttttttaagataccaaataaagggttattagtagaaaatg

SEQ ID NO: 11786 - DNA, 1548 bp, Homo sapiens
  misc_feature (1494)..(1494): n is a, c, g, or t
  misc_feature (1500)..(1500): n is a, c, g, or t
agcggagtgtttggagagatcactcaggcagctggaggaagggagagcacaggggcctggcagcaggaggaccagtcaggaggctgccgaaggacgatgaaggctgagttggaaggaggcaatcatgtcctctcatgcttacctgtgttcgtgatgtctcgggaagcgtaaattgatggtgtttcaaagaaatcaaaatgtggatagaaccacttttcccctcatatgagcaaactcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtaaaaattagctaggcatggtggtgcatgcctgtaatcccagctactcgggaggctgaggcaagagaatcgcttgaacccgggaggcggaggttgcagtgagcngagatngcgccactgcactccagcctgggtgacagagctgagactccatctcaa

SEQ ID NO: 11787 - DNA, 2181 bp, Homo sapiens
gcgcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaagaaatcccagtgcttgtggaggttttgaagtttgtgatgacatggtgactaaggatatcatgacccctctggttgcgctgctaaaagagtgtagtgctggactggattcaaatgagatgtctctgcaggagaaaaaagatcagaacagaaattctattgagaacatagccaatgagactgtgaacgtgctgtggaatatatgtgaatgcagtagtagagcagtgtctatattcaacaaagaagggtgtttggagattgtgttaaagtatttaagtaggttccctaccaatgttgacctggctatttcagtagcatattgtttgcagacagtgactgaggataacccagagctgctgaagtctttcagtgctacagcattgaacatgctggaatcagcactgctttctcccgtcagttccatggaatctcttctattgaagacattggtagcaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccgcccactgacaaggaactgagagagactatagcattgctgacagcccaacagactgctctggaaattattgtcaacatgtgctgcaatgaaggtttgttaacatttacatttagacattttccccctgagccaagagggaaactcccgtggagattttcttaactattccagttctgcgtggtttgcccgcttcccagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaaggtaatccattttcattctaggcttaccgtggagcatgggaaaagcttaagcaaggtattcattttgtgtacaaaagaagcaagctcacacttccaggttgtagatggtggtaagatctgagacaaagctgagcctaacagtactggaaataggcgaaaaggtcattctatatgaagcctaaccatttcacttaggagtaatatgttggaattatgtaagggaatcgtgttaaatgactactctttaacctttgctttactgcctcttttaaatctagatttttgagaaaactgcctttccaaacagcattgcagttgacctatgttctaggaaccctacttggaaacctttgattagaaagtaagaactcttctgctttcaaaaacatttgtcattattttattttatgaaatgatgggctattaaatagaaggtgctgactccccctaggacccagaagttttgttcctgggtatatataccagaaaaatatgtgcccacatgccctagaatacatgtatatgagagtgttcatagcagtgtgtgtcacagttgccccaacccataaacaaacgtgttgtccatcagagttagaatggtaaataaattttgacaaaatcacgcagtacaatacatgcagcagtaaaagggatctgaattagagctactcacaactcggatggaacttacattgttgaaccaaaaaagcgagacataaaagaatacacacactgtgattcagtttttacaaagttgagaaacaggcaacattgaactattttgttcagggatgcataccttggtgataaacctatt

SEQ ID NO: 11788 - DNA, 463 bp, Homo sapiens
ggcgacagagggagactccatctcaaaaaagaatgcacaacccagccccaaaggcacagaaatgtcactgtcacttcacaaagctccttgcatccctgcgcagtcaaggtaagagatgatgcagtgagatttaagaggctgaaggcgcgagtgcccgggaagccgggggggggggttgggcatgtgggaccccctccatgttgacagtcgaggcatacggcctgcaggtccacgcttacttgctgtccatgctgtcggtgtcacaaagctgcatgttgaccagcctatctcccttttctcctggcacaccagaagactacatttcctaggccccttgtatcaaggtgggtccatttgggtagttctagccaaagcaaagtatgaaaaggatcttcaccactgagaggtctgacccacttcagggtcacacaagcacttctcgttcttgtccatggcacccttt

SEQ ID NO: 11789 - DNA, 875 bp, Homo sapiens
cttttagcagcttaatgtctatacaaaggaattcattcattcacttctttttttctcaacacgtatggaacccctgccacacaggcagcactgtcctagctggaaacatgagtagataaagtcactgattcaaaggaactttattctactggtgggcacaaaatggcagctaaatttataaggtaacattggctgctttactgaaaaaaacaaagcagggtaggtgggtacaatgagtgattgtcaagagtatgactattttagacacggcggtcggtaaaatccgcctcaaggtggaggcattagaaccaagacctctgctcaccagcaggcagtctgaaaaagtattagacaaaataacccagaaaacaaagacttggggtggcaaacaagcttcaagtgctcaagaaactgtaagaaatgttgatgtgactggcctgagtttcagtctgaaaactttgggtgctaaatagtgaacatagttgcagaaaaatagaaagtaaaagaaagcattgtacgtttaaacatatgcaaataaataggtagaaacagatagaaaacagtatgttttagggagtataattttggggtaacatatcttttattatttttcctaactggggagggggtggaagactatattgccaacaaaatgaaagcttttaccccctaaacatgtcaaacaattcagcagctgataattacatttattggagttaaaaaataaagtgggatcttaaggagaattagtttatttgaatcatggtgactgagagtgaaaagagaaaaagacaaatgtgaaacttctgtttcatccactaaggagtcagcagaaagtaccacggaacctacagacctcaaacaccaaaaaaaaa

SEQ ID NO: 11790 - DNA, 728 bp, Homo sapiens
gaggcgggggttgcagtgagccgagatcataccactgtactccagactgggcaacaagagcaaaactctgtcttaaaaaaaaaaaaaaatttaataatgtcagcctgctcccacacttcccaaggagaatttggtctttgctaacttgggcctcagttgagcagatttggagtgaagggtgaagatgagaattgtcctccccggaaaaggcccaagagccccagacagagtttaatccccttgaataggtaaaagagaaatgaacagatatgtaaggtggtcagggggagaccagagctgggtttagaaggaagtagagtgttaggaggcagctgccatgattgtaaatatacaggtgtacgtgcacatgaagtgggaataatgacatctcccccattaggttgctatgagacctaagaagcccgcatgctttgctgtggactgaatgtttgcataccctcctgaattcatatgctgaagcctaaatccccaatttgatggtatacgaaggtggggcctttgggaggtaattaggtcatgaaagtggagccctcatgaataggaagaatgcccttataaaagaaattccaacaagctgccttgccccttttctgccatttgagaaaacagtgagaaattgctgcctgtgaaccaggaagcgggtgctcaccggacactgaagccactggcaccttgatcttgaatttcccagcctccagaactgtgag

SEQ ID NO: 11791 - DNA, 3096 bp, Homo sapiens
  misc_feature (3)..(3): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (15)..(16): n is a, c, g, or t
  misc_feature (21)..(23): n is a, c, g, or t
ggnctgcngncntanngcggnnncgcggggaatttcgagtggtgttggagcgccggaggctagtgggtggctgacccccagcatcctcgagagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcaagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcacaaaaggattctttcaacttctttattgcaagaaacagttgagttaaatgtttgtttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccagcccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgag

SEQ ID NO: 11792 - DNA, 1921 bp, Homo sapiens
  misc_feature (3)..(3): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (15)..(16): n is a, c, g, or t
  misc_feature (21)..(23): n is a, c, g, or t
ggnctgcngncntanngcggnnncgcggggaatttcgagtggtgttggagcgccggaggctagtgggtggctgacccccagcatcctcgagagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcaagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtc

SEQ ID NO: 11793 - DNA, 1696 bp, Homo sapiens
gagagagagagagagagagagagagagagagagagagagagagagagagagagatgagagagagagagatgagatacagagagacatagtgagagaatcttttagagaaagaggaagcctgagaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcactttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccagcccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgag

SEQ ID NO: 11794 - DNA, 3043 bp, Homo sapiens
  misc_feature (3)..(3): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (15)..(16): n is a, c, g, or t
  misc_feature (21)..(23): n is a, c, g, or t
ggnctgcngncntanngcggnnncgcggggaatttcgagtggtgttggagcgccggaggctagtgggtggctgacccccagcatcctcgagagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcaagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcactttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccagcccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgag

SEQ ID NO: 11795 - DNA, 2411 bp, Homo sapiens
aagcgttgcagcaggaaaacttccatctcgctctcctggctttgatcctcactggacatcagaccagaggcaccgaagggagggaggatgcgagatgaccggccctttggcaacctgaccatcgacttagcagagccttcaaaagcaagccaggggctggctgcacgaccaaagaggcgccgcgcctctcgtggatgtgtgtgtgtgagtgatccagcgagtgtgtgtgcgtgtgagggtgtgtgtgtgtatgcctgtgtgcacagcacaactgtgtgcgtgtcccggtgagtgtgcctgtgcatgcgtgagtgtgtgtacgtgtgcatgtgtgtgtgagtgcgcttggttattactattattattatttttggaagaaaaatctttgaaaatctggggcaggttactgtgctcctagggtgattcttcttttgcaagaggagctgaccagggcaagctactagagccatttctcggcaagtaaagagatttttccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagatgtcatctcaaactaagttcaagaaagacaaagagatcattgctgaatatgaagcccaaataaaagttccagttcagacatcataagagatcttttagaagaagaggaagcctgggaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcacaaaaggattctttcaacttctttattgcaagaaacagttgagttaaatgtttgtttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccagcccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgag

SEQ ID NO: 11796 - DNA, 1755 bp, Homo sapiens
  misc_feature (3)..(3): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (15)..(16): n is a, c, g, or t
  misc_feature (21)..(23): n is a, c, g, or t
ggnctgcngncntanngcggnnncgcggggaatttcgagtggtgttggagcgccggaggctagtgggtggctgacccccagcatcctcgagagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcaagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataagctctacttctccaaaagacgttacatattccaaggatcctgcgtctcaacaaaccctttcttctgcaaaagaacagcctgcttttattccaagctctgagattccttataggaagctgtttctctccagttatgccatgttatgccttaacctgggccaacagtgcctacacacggagaatgcaatggttgaggccaattcattaacagggattgtttagccacatccgttgttaattgacaacatgtctatggaattagaagcctcgtgt

SEQ ID NO: 11797 - DNA, 1763 bp, Homo sapiens
  misc_feature (3)..(3): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (15)..(16): n is a, c, g, or t
  misc_feature (21)..(23): n is a, c, g, or t
ggnctgcngncntanngcggnnncgcggggaatttcgagtggtgttggagcgccggaggctagtgggtggctgacccccagcatcctcgagagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcaagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataagtgagttctcataatcatgaaataagcatgcactttgacctgagaaattatacttctatgcagctgattttcaaacaaaattatatttgtgctttctggtttaaagaagtagtaatcctcatgcaaggtaaagattttcagtttactacttgtttctatatatttctgctaagaaatggaatcctatgtaataactgtagttatgtatcagatgttatttctgtatggataaattgttcttatgggcaattaatacagtcatgcatcacttaacaatggg

SEQ ID NO: 11798 - DNA, 1744 bp, Homo sapiens
  misc_feature (3)..(3): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (15)..(16): n is a, c, g, or t
  misc_feature (21)..(23): n is a, c, g, or t
ggnctgcngncntanngcggnnncgcggggaatttcgagtggtgttggagcgccggaggctagtgggtggctgacccccagcatcctcgagagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcaagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataaaaacgatcttcaagacacagaaataagtccaagacagaatcgccgcacaagagggtcataagcaagccaaacttatgaggaagatgaagccataagtaagcagaacctataaataggctaaaaatatgagatggagggctgggtgcggtggctcatgtctgtaatctcagcactttgggaggctgaggtgggcagatcacttgaggccaggaattcaagaccagcctggctaacatggtgaaaccccgtctgtactaaaaa

SEQ ID NO: 11799 - DNA, 1567 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattc

SEQ ID NO: 11800 - DNA, 936 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgtaatcattccttgaagtagttggagatggtgctggtatgccactgaatgaggtctgagcaggttttcttcacatctgaggggacagtgccagccagtcaacttttggggtggggctgaagtctgctgaaaatctgcagttttacatgtttcatgggacattcttctgtgcaataaagtttgagaagtatcattcttg

SEQ ID NO: 11801 - DNA, 448 bp, Homo sapiens
cccccgggctgccaggaattcggcacgagctgaggagaaactctctccacatggcacaaattcaggcttacatggtccttggttcctgggatctccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaacttttgccat

SEQ ID NO: 11802 - DNA, 386 bp, Homo sapiens
gcggccgcctactactactaaatttgcggccgcgtcgacagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagactgtcgacgcggccgcgaatttagtagtagtagtcgacc

SEQ ID NO: 11803 - DNA, 177 bp, Homo sapiens
gaaacacgctatagaccactgattacagaattcagagcacaggtaccattgaagatgttcttttttcataactatatactattccattgcatgaatattctgtaatttatttaatcccctatggattgataattaggttccactctgggcagctaactcagctcaaggtgggttgta

SEQ ID NO: 11804 - DNA, 6310 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaacttttgccat

SEQ ID NO: 11805 - DNA, 6205 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgatacggtttagagggatcctctagaacgcctc

SEQ ID NO: 11806 - DNA, 6147 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaa

SEQ ID NO: 11807 - DNA, 6327 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaaagaaagaaaggatttcttggacctttaccaaaccatttgttacagaacacccggtaaacttaaatattgtcaccaacgagcgattagactgggatgaacacaattctgcccggggggggggccggacgacacttcccccttttggggggatttattgctcgccgcaagatggcggacatt

SEQ ID NO: 11808 - DNA, 6390 bp, Homo sapiens
cgcaggcggaagtgccgtggttccgacgctgttgtcacagggtggcctttggtcatctgaaatccgcggtcctgagtgctgggaagaggggctagaggacgtcgggccggggccgggatacacagcaggtctatgcagcagtaaggtgggcgatccacctgggacgaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaacttttgccat

SEQ ID NO: 11809 - DNA, 5773 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacagaccgtcaaatcctcagagtca

SEQ ID NO: 11810 - DNA, 5339 bp, Homo sapiens
aaatttccggccgcgtccgactggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaacttttgccat

SEQ ID NO: 11811 - DNA, 3130 bp, Homo sapiens
tgcataatagataattgagaagatagggtggcatggctcacaacagtaatgatggcttcatattttttttccttctttttaatatatttatcttgggcaaattctgtctgtctcggaatgtgtaccatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaacttttgccat

SEQ ID NO: 11812 - DNA, 3029 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaatgaagttgctaggggggggggtcctctaagtc

SEQ ID NO: 11813 - DNA, 1987 bp, Homo sapiens
gacgaatgtgacacctgatccaataaatttctcgttatacatcctacagaaatacccacacaagtagcaaaatacatgtacaggaatgttaattacacttctatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaacttttgccat

SEQ ID NO: 11814 - DNA, 1470 bp, Homo sapiens
agattgtgtggtggtcaatatgctgggttatcagcgatcagtatcgagatttaggggattctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaacttttgccat

SEQ ID NO: 11815 - DNA, 784 bp, Homo sapiens
tcctgacttgcaatgatcaccattctaagcggcacgagttggtttctcaagtggtttgatttgcatttctctaatgaccagtgatgattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaacttttgccat

SEQ ID NO: 11816 - DNA, 1423 bp, Homo sapiens
cgcgccgggggtttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtggtgaggaccagaactctgtgtgggctagagggtgaaagagagtataggccttttgttcagaactttgcttgttctcactggtggggggatcatatcactcttaatctaatatctcagtttttttctgattaagttgattttgctggcctcagaccttttattcctagacattaacatcttcagccttttcttccctttcagtctccttcctaaaaagagttgcccatgtcaggctagcatttgccttactttgagccagcacccacccatggaccaagtccctctattttgcattcagtattacttgtcatctgttttacatccttttactttcaatctcctgcctaattccattggtacagtaagcttacctgaaaacctcttctaatctctttgttgtatatcactgaaatctttctaaatatttatttctgatttccttcaacgtctacctagagtcattttcttctaagaagcttcttttgtagaaatatttggagtaatttttttcctttttctaagtatttatgcaaaaaaagcctccttagctataacatgctttaaatgcagaaaaagcttttttaaaagctcaaagttgtattaattcacgagaccagtctttcccaatatattagccattaacaccatatacttatgtgtatcctttgatatggcccagtatat

SEQ ID NO: 11817 - DNA, 479 bp, Homo sapiens
ttctttatccacctttggagtggaataaatctcaatataagctaaataacaacattacaaatcaaagaatattcaaagcaaattcaggttaaaaatgaacattttaaagatgcattttctttaaaaattaacttttcacttcatatgtttacaagatttaacactgggcaaagggtggatctatctagcacacagtaatatggtaattcaccactttccctgaaaggccaaaaagaatgacttgctaaaagtatttactaaatatgcaccaaagataatgacttaactagtaactgtgaaactgtttctaagactgtgggctgagataaatattataaaatatagacaaaatttttatatttctaatactggatattctgtgagtaccacgggttctcccagaaggtgatgcaaatcttgatttttatctgtacagatgtcttcatttttttaaatttaaaattattttaggaccgtgt

SEQ ID NO: 11818 - DNA, 437 bp, Homo sapiens
gtaacacacaataacatttaaaattcaatcttcagctttgaacttgtcctacaagatacccttttctgataactttgaattgatcccttaactgctactgcatttctactacatctctcttaatttgctatacttaccttcagagaagactgaatgctgatagctgcctttcccttatacgttagtgcatttcctaaagttcacatttgctgcagaccatactgctgtcactaaggaaatatccctggccagggtgggctaaaaattaaaccaccacccaatgccattaaagctaatgcatctggagtaacatgtaattgttgggttttggagcattacttcagtatctgacttaaggaaaggtgatatttttggaatacacctatgtaaaatggtctctcctaattttatatcttcacaaaatcatttatttcagg

SEQ ID NO: 11819 - DNA, 337 bp, Homo sapiens
agccttcagggtagaaggacaaggcctgaggttgctagagattacttcctacccaatcacacataaaacccaatgttttatgtgtgccataaaaacattactttctatgtgtgttgtgtcctgaaaaggttgcaaagcactgccattaccagtttttacaattcccttgccctgctgttctcctgctatacatccatgaggaaacaccattcagtccaactatctttttttgtgctcacacttgagtgctgcaaaagcaaagtcacagaaacccaaagatttgaagtactgtacacttgaagtcattaaagtcaaacggtccttcatcattgccagg

SEQ ID NO: 11820 - DNA, 490 bp, Homo sapiens
gagatcatattcctaattctgtggtaccaaaatatttttattaaatgatgttgattggatgttttttcttacatggctaaactaaaagttggcaacccctacattagtctctactttttgttctttttttaattaaattttattggtccatggaatctaaaagtctaggaacattgtcttggatagtgtgctgttcatgaaggtagctctctgggcttagtggtatgactgccgtatgtttcctattccctctgatcttcttaacaatggtcagtagccattttgtgattctatcagttggttcatgtgatatcatatgtctcccccacccatatttcctcagaacattcttctgcctccctacacctgtctcctttcgcacttgagttggaaaatgattgtaccaaagcctgcacaatattttttaaagcagtgaagtagggtagatgccttggtacccttaatctagcaaaagatctttaaaagagtc

SEQ ID NO: 11821 - DNA, 284 bp, Homo sapiens
  misc_feature (110)..(110): n is a, c, g, or t
  misc_feature (112)..(112): n is a, c, g, or t
aaaactcgagaccaggaggtggaagttgcagtgaaccaagatcatgccacttccactgcactctagcctgggcagcagattccatgaatgaaagggagagagagagggangngaaaaaagaaagaaagaaggaaaggaagaaagaaagaaagaaagaaagaaagaaaaagaagaaaagaaagaaagaaggaaagaggaagaaagaaagaaagaaagaaagaaagaaagaaagaaagaaagaaagaaagaaagaaagaaagatccaaagaagggcaaagaggaag

SEQ ID NO: 11822 - DNA, 397 bp, Homo sapiens
ggcaggagaatcaggcagggaggttgcagtgagccgagatggcagcagtacagtccagcttcggctcggcatcagagggagaccgtggaaagagggagagggagaccgtggggagagggagacggagaggcagagggagagagagagggacttaactttcatcttgtgtttcagcaagaaccattttaagatctctgttgcatttctgtcctagtagtttaaatgctgggattacaggcatgagccactgcgtccggcctgaagcttttccattaaaaaaaaaaacgtttgcggccgcaagcttttttttttttttttttttttaaagcaaatgacaaagacccagtttaccagctttacttttttaaacctaagcttaacattacatatttaaaca

SEQ ID NO: 11823 - DNA, 904 bp, Homo sapiens
cactaatatcacagtctctctgattaagaaactcaagagagtaaataatcttctgataggtttgggaggggctcttcggttttactaccttcttttttttgagaaaaagcatccagcctgggcgacagagtgagaccccgtctccaaaaataaataaataaataaataaatctgaaggacactgtcaagagtgtgaaagggcaaccagactaggcgaaaatatttgcaaataatttacctgaaaaggatgatagagatttataatcagaatatataaagaacttctacagctcaacaacagaaaaaccaaacaacccaaataaaagatgagcaaaggactttacattctgtgtatagacttttctccaaagaaggtatgcaattggccaataaatatatgaaaggatgcttgaaatcttcagtcattagagaatgcaaatcaagaccctagggagataccactttacactcactaggttagctattatttaaaacaaaaaaaggaaaataagtgttgaagatacggataaattaaaaccctcatgcatcactggtgggaatgtaaaatggtgcagccaccatagaaaacaatttgatagttgctcaaaaagttaaacatagaactaccatatgacccaatacttccctcctaggtatatacccaaaagaattgaaagcagggatggaagcagacatttgtatactaatattcgtagcagtattattcacaatactcaaaaggtataaacaagccaagtgtccgtcaacagatgaatggataaacagcatgtgatttatacacagaatgtaatattagtcagtcattaaaaacaaagttctgctatataacatagcatagaagaatcttgaacacattaaaacatgcaaactgaaataaaccaga

SEQ ID NO: 11824 - DNA, 399 bp, Homo sapiens
gatggtaagcttttatgtgaatagctcctaaataacattaccatcactcactactactggtatggaaattgagttaggataacagagcctgagttcccccatgagataacaagatgcttctgaatataagtcaaaattggagtatagattgtctcacaactctactgttttttgtttcttttcgtctttctttctgttttctctttttgtccctctctttctctcttgtctgaagagtctgggacgctgaaggctataaacatcatggtttgttacacactttcgatgtctgctcaaatgtggtgtaccatttctaaaccacctcctgttaaaccgtttgtgggaaagttacatttaaaataaatcatttcatgatcagcagttttattggtgcgtggt

SEQ ID NO: 11825 - DNA, 418 bp, Homo sapiens
gttcataggatggctgggtaagtggctgtttgttttttccttactgtggatatgtatcagtgaaggaatctgtagaacattcttgatgggaacatttagtcatatcaagtcaataaattaatgtttaggctgggcgcagtggctcacgcctgtaatcccaacaccttgggaggccaaggcgggcagatcatctgaggtcaggagttcaagaccagcctggccaacatggtaaaatcccgtctctactaaaaatacaaaaattagctgggtgtggtggtgcatacttgtagtcccagctactctggaggctgaggcaagagaattgcctgaacctgggagatggaggttgcagtgagctaagagtgcaccattgcactctagcctgggcaacagagtgagactctgtcaaaaaaaaatt

SEQ ID NO: 11826 - DNA, 460 bp, Homo sapiens
atctcctcgtctgccatttgctaagactgtgggaaaagcacagtgtttgggcggggtgtactgattttccatgtacagtctgtcacagcttcccttggctaggaaaggaaaatcccccgacccattgtgcttcctgggtgaggcgacgccctgtcatgcttcaccttgccctccgtgggctgcacccactgtccaaccagtcccagtgagatgaatcaggtacctcagttggtgatgcagaaatcacccgtcttctgcgtcgatcactctgggagctgcagaccagagctgttcctattcagctatcttggaacggaacccagccatttctttttaatcatcacatgttaaatttgaaggaactggcttagtttttagaagagtgatcggtctcattaaagtggagggaaaaataggacccttaaggaaaatcaaaagatagtgacttaatttagctaga

SEQ ID NO: 11827 - DNA, 444 bp, Homo sapiens
caaaacaactacaaattatacgaatttaattatttgtagaatacaagaattcagtaacttctgctagcatacaaagtctcaccgccttatgagcaaaaataacccatcagaaaaaggaccaacctgatttaaaaaagaacacattaagaaattcccaaggctggacgtggtggctcacacctgtaatcccagcctttggaaggccaagccaggcggaatgcttgagcccagaagtttgagaccagcctgggtaacttggtgaaagtctctaggaaaaaaaaaaaaaaattagccgggcatgatggtgcgtgcctgtggtcccatccacttgaaggctgagatgggaggatcgtttaagcctgggagacagaggttgcagtgagccgagatcatgacactgcacttagcctgggtggcagagcgagactctgtcaaaaaaaaaaa

SEQ ID NO: 11828 - DNA, 602 bp, Homo sapiens
ggcatattcgtcaggacccccacgccgctccagggttttaaacaaggccaacatttgatgtcacatgtgaaaaaagacctacaagtgaagtaggtgggccaaaagacatgcacatttaaaaatgtgctaactatactagctaaaacctgtgcttaatatatgccagaaactgctctggtgctgttaatggagcctgctaaacaaaactgcttctcaacaatagaagttgtactacgctatggagtggacactccatagcaatgaaatgttttggagtgcctgtttcctcatctcagcaacataatagttctcaaacttcttagtctttgttattctgatatagataaaatgttttctattatgagtttcattttttttttatgtttaacagccatttgtggggctgagtgcagtggctcatgcctgtaatcccagcactttaggaggccgaagcaggcggatcacttgaggtcaggagttcaaaaccagcctggccaacatggtgaaaccctgtctctactaaaaatacaaaaacattagccgggtgtggtgatgggcacctgtaatcccagccacttgggaggctgaggcaggagaatcgc

SEQ ID NO: 11829 - DNA, 641 bp, Homo sapiens
atacatttaagacacttatcctggtggcaagaaatagtaaatgctcgataaatattagctaaaagtatatatgccgatatacatgggttaatacagatactacgatggagtattagataaagttctagctcactgcagccttcaccttccagactcaagcgattcttctgcctcagcctctcaagcagctgggaccacagatgtgtgcctccacacatggctatgttgcccaggcaggtcttaaactcctggactcaagcagtcctctccccttggcctcccaaagtgctgcgattacaggtgtgagccactgttccagccctgaggttcttgatagtctaggtagagaggaaaattaaagaagttatgtggaaaacatacattctttaggagagtttttcctggcaccaaataaatattcatcccacagagttagagggatattgagtactggacttgattatgtccttgaccccagtactaaatttgtgaacttggacaagttatttaacctatcatgtataaatgtattaacatactgtatgtttacttttagtcacttttgagattgataaaaagtgctgaataaagtgttttgggaagtgcctttttcattcaatcctgtacacctaaaacttgtt

SEQ ID NO: 11830 - DNA, 738 bp, Homo sapiens
ggcatattcgtcaggacccccacgccgctccagggttttaaacaaggccaacatttgatgtcacatgtgaaaaaagacctacaagtgaagtaggtgggccaaaagacatgcacatttaaaaatgtgctaactatactagctaaaacctgtgcttaatatatgccagaaactgctctggtgctgttaatggagcctgctaaacaaaactgcttctcaacaatagaagttgtactacgctatggagtggacactccatagcaatgaaatgttttggagtgcctgtttcctcatctcagcaacataatagttctcaaacttcttagtctttgttattctgatatagataaaatgttttctattatgagtttcattttttttttatgtttaacagccatttgtgtgagccactgttccagccctgaggttcttgatagtctaggtagagaggaaaattaaagaagttatgtggaaaacatacattctttaggagagtttttcctggcaccaaataaatattcatcccacagagttagagggatattgagtactggacttgattatgtccttgaccccagtactaaatttgtgaacttggacaagttatttaacctatcatgtataaatgtattaacatactgtatgtttacttttagtcacttttgagattgataaaaagtgctgaataaagtgttttgggaagtgcctttttcattcaatcctgtacacctaaaacttgtt

SEQ ID NO: 11831 - DNA, 1065 bp, Homo sapiens
gcaaaggtaagagaattcactgtgaattaattattcattgaacacctattttgtgccattgactatccttattgctgggagcacagcgtttaaaaaaaaaccaaaaacctttctcccactctaatagatgagtcacataatgggaaaacaaacaaatgtatcatctattaaagtgggagaacttggttttgtagttttaaaagtattgtcatggaaccaacgatactgcttgcatctatacaccatgattagagaggaagtggatggagagtgtgtgtgtctgagagagagaatatttagaatgccaaaagcgggcacttcaaggaaggctttttttatttaaaaaaaattagctcattctacatactttagaaattacctttgagtagcaaatgttaaggatataaatactttgcacgtatattccttgtttatagttaaccatatgttattttttacctgaaaaatactaaaacatattctacctacgtgcaatctaagttttgtagcagagtctttttacgggggccaaacaattctggactaatttttaaaaccctgaaatggctcactgttttgaggttattttgatggagtatgaatttacttctttgtcatttggagaaggtgcacagtattattatgaacagagaagagctgtatgaaaactgatcttccagcatctatcatctccttttagtctaatgagatactgccattatctcctgatgaaatattgttctagaaaaccttaccccatcatacgatttctgcagatcttacaggagcaatctgagctcaagcaatattaattactgtttcatttgtccatttgtctgtgtataatcatgtattttaatgatcttctattttctatggtttgtgtagatttggagactaattcaaaagagttgaagttttttggacatgtttagttgaatgtgcagttctcttttgaagaatcctgtctccaaatcctgttttgaaaagagtgttgatgagtagcacagcacctgtcatattgtgagtgtgcaataaaatcatgccttttcagcagaccttaac

SEQ ID NO: 11832 - DNA, 1987 bp, Homo sapiens
actctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagagagtccacactggggagaagccctatgtgtgtggtgaatgtgggcacgccttcagtgcacgccggtctctgatccagcatgagagaatccacacaggtgaaaagcccttccagtgcacagaatgtggcaaagcttcagcctgaaagcaactctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcacttagcgtgctgttcctgtggaaaaacttcagagactacctgttttattttcctcaacatcttgaagttatgttggagagtaatcatacaattgtagagaattttggtaaaaaacagccataattctttaacattagtttatttgaactaagggaatttaaggcataagaaccattatcccaataaaatcttacattccaaataaagttctttttctaagaacattacatgcccttcctaaatatcaattaaccatactaattattgcacttaaaatttgaaagtcggactattttcagtattctcttaaaagactaaagtattgtatggataaagtgatataaaaagatattttcatcaagcatcatgtaaaatggttggaaatcctaagtgtgtggatttccatcctaagtgtgtggagtcctgttttgtatgaaacaaggaaaaagcttatatattagtgagaaattacataaatttaaaaaactttttgtatgtgtgtgtggagatagtcttgctctgttgcccaagctgcagtgcagtggcatgatcttggctcactgcagtctcccccaccccaggttcaagcttttcttgtgcctcagtctcccaagtaactaggattatagatatgcgccaccacacctggctaatttttgtatttttagt

SEQ ID NO: 11833 - DNA, 1933 bp, Homo sapiens
actctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagagagtccacactggggagaagccctatgtgtgtggtgaatgtgggcacgccttcagtgcacgccggtctctgatccagcatgagagaatccacacagtctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcacttagcgtgctgttcctgtggaaaaacttcagagactacctgttttattttcctcaacatcttgaagttatgttggagagtaatcatacaattgtagagaattttggtaaaaaacagccataattctttaacattagtttatttgaactaagggaatttaaggcataagaaccattatcccaataaaatcttacattccaaataaagttctttttctaagaacattacatgcccttcctaaatatcaattaaccatactaattattgcacttaaaatttgaaagtcggactattttcagtattctcttaaaagactaaagtattgtatggataaagtgatataaaaagatattttcatcaagcatcatgtaaaatggttggaaatcctaagtgtgtggatttccatcctaagtgtgtggagtcctgttttgtatgaaacaaggaaaaagcttatatattagtgagaaattacataaatttaaaaaactttttgtatgtgtgtgtggagatagtcttgctctgttgcccaagctgcagtgcagtggcatgatcttggctcactgcagtctcccccaccccaggttcaagcttttcttgtgcctcagtctcccaagtaactaggattatagatatgcgccaccacacctggctaatttttgtatttttagt

SEQ ID NO: 11834 - DNA, 1934 bp, Homo sapiens
actctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggctgatccagcaccagagagtccacactggggagaagccctatgtgtgtggtgaatgtgggcacgccttcagtgcacgccggtctctgatccagcatgagagaatccacacaggtgaaaagcccttccagtgcacagaatgtggcaaagcttcagcctgaaagcaactctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcacttagcgtgctgttcctgtggaaaaacttcagagactacctgttttattttcctcaacatcttgaagttatgttggagagtaatcatacaattgtagagaattttggtaaaaaacagccataattctttaacattagtttatttgaactaagggaatttaaggcataagaaccattatcccaataaaatcttacattccaaataaagttctttttctaagaacattacatgcccttcctaaatatcaattaaccatactaattattgcacttaaaatttgaaagtcggactattttcagtattctcttaaaagactaaagtattgtatggataaagtgatataaaaagatattttcatcaagcatcatgtaaaatggttggaaatcctaagtgtgtggatttccatcctaagtgtgtggagtcctgttttgtatgaaacaaggaaaaagcttatatattagtgagaaattacataaatttaaaaaactttttgtatgtgtgtgtggagatagtcttgctctgttgcccaagctgcagtgcagtggcatgatcttggctcactgcagtctcccccaccccaggttcaagcttttcttgtgcctcagtctcccaagtaactaggattatagatatgcgccaccacacctggctaatttttgtatttttagt

SEQ ID NO: 11835 - DNA, 517 bp, Homo sapiens
accctactgccaagtgtctgattagcagcatcctgaaaggaaaagccggctgcctcccctgaagtgggtccccagttctgtagtccagcttgctccagaggttattgtcactctgccaccaaaaacaaccaatacagtcaaagctcagcagctccagctctagctggatgaattatcttctaaccactcttaccccacattgtacaactgcatccatccttcctcagttgtacagacaacttaaatatttcctctacaccattggttctcaaccagtggccgttgccccgtgctgccaccaccaggggacatttggtggagtttggagacatttttggttgttaaagccataggatgctactgacatatagtcgggagaggccagggatgcttctaaatatcctgcaatgcacagaatagttcccccacccaacaaagaattatctagcccgatagcgctgagggtatgaaaccctgctgtacacagtgatgtcacatactgaggtctcattgttat

SEQ ID NO: 11836 - DNA, 575 bp, Homo sapiens
attatttaagaatcagggcaggaatcactgcttcgagaagcgtttcttgattcctaaagtttaaattaaatgccctcattcatgttcttcttataatttttctgtcattttactcactacattgattagtaaatacctggctttccctcataccaattagctctttatagcaagagcacatagcaagcatttgatacatttttaagtaccaagatatgaaatctcaatatcatacatgattaaaagctttatatattttagtgagtaattaagtttacactgtgaataaggattaattcccagatgaccatctacagttactaccacatagagggtatacacgatagatcgattacaagaatataaaacttattttccttcctgtatccacatttctttgcaatgtgaatttgcaggccctctcaagaagtggagtctatttccctaccccttgaatctgggcaggctttatgacttatttatttggctaataacatacagaagaagacatgtgtgtcacttttaagcctgggcctcaagtggtctcacacaagtcttctttcccttgtggaact

SEQ ID NO: 11837 - DNA, 181 bp, Homo sapiens
gtgagtcccatacaggctaaaggggcagtgagacatttgtcctacatggggacagatcagtgtatttaagtgtagtggatactgttttctacgaaattgttcataaatttttttttattttgagatgggatctcattgtgtcatccaggctggagtgcagtggtttgatcatggctcacag

SEQ ID NO: 11838 - DNA, 435 bp, Homo sapiens
tggaattccatgacaagtccaataacattaactagctttcaaggtcgatgtcagcaaaatgaaattgccattagaagcatcacaatcagtgtccttcctcatttggcataggtggaggaggactgcagagttacctttagtaatatctcatgatacaatgatgcttcatgtcaaatagcaattaatatcattttaacttaaataatgtggatattattttacattttgatattaatttttttaaaacacttgaggtttaaagaaaagataaaacaaggtagctttgtcaagaatgagaatttagatcttcactggttaatctctttaatttcaaatttagctacttaagtggaacgtcccaacttaaaataaatgtctagaaattgcctcataggttaaagaactctcaaaaacctgtccctgacaatggtattt

SEQ ID NO: 11839 - DNA, 413 bp, Homo sapiens
tggttttcactttggaccataagcatccgtattgtggtaagagtgttgggttgagtgactcagtgctgtgcctgctttctccacctgagtgctactgatgatgggtctgggggagcagcatgagcattaacaggggacttactaaaaataggaagaataggaagatacagacaaatatttcttatttgtctcacgtgtatgaggaatctaaaaggttgaactcctagacgcagggagtacaaaggtggataccagagccaagaggtagggaaaatggaagatgttgtttaaagggtacaaacttttagttataaataaggttcgtgaatctaatatatagcatcatgattatagtagataataatgtttttgtatacttgatacaataaaggaaactatgtaagatgatacat

SEQ ID NO: 11840 - DNA, 552 bp, Homo sapiens
agcgaggtgtggtggcatgcacctgtactcccagctactggggaggctgaggtgggagaatcacttgaacctgggaggcggaggttgcagtgagccgagatcacgccactgcaccccagcctgggtgacagagtgagactccgtctcaaaaaaaaagaaaagttcatgcacagctcacaacaatgcactggtaacgggaagcctaactaagaagatgaaaagtgaaatttggggggcattaactatggttcctttcaggtctaaacctcataactgacttccccagcaggctttgagcaatcaaaacacccaggacaaatcccataagcatacctaattgaataatccagattctgtttgcttgggtttttgaagcatcaaaacagttcctttgtgtgcttactttggctcccctgcagttttaattaagcctcccaaggctcacaagcatattaaaattaggtggaaagaaaacctgcagcctttgatgccaatgaccacaaggtgcaagtatttgggtttgatcttttgctacagcagctacagctgatg

SEQ ID NO: 11841 - DNA, 324 bp, Homo sapiens
attattttcagatctttagcacaaactggaaaaaacacccagacattttctttaaaccacttaaaacaacaatacagtctggaccgcagacatactggcttcatctccaacctcaaattcagccctcaatatttgcctatataagcaatgtttacagcctcagaagccaaacaatctcttcttttagtttttatcttgattccaggccccatactttattcttatctgagagtccttggaatattttcatttcctgaagttctgaaaaatggattgtctctgctgtgtagctcctctctcctttctctcattctttatagctta

SEQ ID NO: 11842 - DNA, 383 bp, Homo sapiens
tttttttttttagaaaaaggttttaatggacatttggtaactacattctgtttttgacaacctccccattacatttctagttatctattcaaaaccaaaggacaaaaaataaaaaaataaaaactacaccagtttacaaagaacaatggggcgaaagcaaaatgtattccttgctgtttcacacgtgcttttaaaggaaacaaacaaccaaacaaacagagaaattgtagttcctaagtttcttgacccaaatccaagcagactcattgacaagcctaaacctctccgtgtgtcttcctgcttctgaggctaaaatatggataagctcaaagtttgacacatggatatattttcaaatgacatgtttagtgtaaaaaaaaaaa

SEQ ID NO: 11843 - DNA, 474 bp, Homo sapiens
gatttgatagaggaagtcagtccttggtctagatgggtacttgtcatacagtaggaaaaagggcgggggcagttgtcctttattctgcctctgcactattcacatgtggagcacagtgatttgtgagagtatgtataaccttcgtgaacatcactggcctcagaaccctcccttgccaaatttacctgcatctgtgcaaagacaagtggagatattgatgatatgtgcatatcccagagggaatagcgtttgctttttgatgcatgcccacccttgcataattgggaggttttaacatagcatatttcaccataaaggaattttattctaagaatgttaatcagaatatccctaagtaacagaagttcccatctggtcagttgcaaggtgaccaaaacactttcttggtttgagtatagtcatatgttctgtcaaatgatgttttggtcaacagtggacttcatgtaaggtagt

SEQ ID NO: 11844 - DNA, 318 bp, Homo sapiens
aagaaattataagatctgaaaagacaggagaatggaattctacatgggaaaaatgcacacacttggaatcacaaagtgtgttcaccaaaagagggtagaccagctggcctcaaacccacccctaggtctccctgcatttgatcttattcttggaagactcatgtgtcagtttcactattatttcaacaagctggtaaagaaagtacaataatggctgctaacatttactgcgaacttgctatgtggtaagggctgtgttaattgctatatatacattattgcatgaatgaagtagggacctgactatctccattctac

SEQ ID NO: 11845 - DNA, 395 bp, Homo sapiens
tttctgattactctattgcccttacatgcaagcaactggacattgactaaatatggatagcatgtttggtatatagacataaaatatgggttataaaggagattcacttagagaagaaaagccatgcagccttttggagagaaacccccaatcaataggccattgggactgaacacaggaataatcaatcacaatagacaatgctttctgagtcctatgtaggtcaggctctggagtggctggtgctgatttgctccagatctgcagtggctccccctccactcgggaggctgaggtgggaggattgcttgagcctgaaagggagaggctgcagtgagccaagatcatgccactgcactccagcctgggtgatggagcaagaccctgtcaccaga

SEQ ID NO: 11846 - DNA, 484 bp, Homo sapiens
gaaagatcagagactcttttgctaggctgttgaagttcgaggtgaaatcatcttttcttcacttgttaactgaaggcaaacccttcgaaatatcctggccttgttgttcatgttgtttttgcatttttatcatcagggtcacttttgttatagatttgtcatagtgtggatcaacctgcattcttgtcagggtttgcaagcctccctgccaacgtgctgatccagtgcctgtcctggagttacccacctcatcctggtctgtctttcttagaacaatgactttctagctctagcctaatacaataatttgtttggtggtttaaaggagttggccaagaaacacaggcaagagctagcattcccaaacttaatccttaatctgtttgtcttacttgtttatggagaaaaacagaaacaaaatcaccctaagattgtgctatctgaaaccaaaacacctccaggaagatgttccaggctgaatgtc

SEQ ID NO: 11847 - DNA, 607 bp, Homo sapiens
aaagtgctaagattacaggtggcagccaccatgcctggccaagaaggaaactttaaaacaggtgtcaaggacagcaaggatttgaataattagcttagtacacagagggctcactacatatctaaatttgcaccgaacagaggataaaattatgttgtttctgaaacacttttaaaaatcgatcatgtaccagaccacaaagaaaaatatgaactcttaaaagtagaaatcataacaggccacatcttgttaatgtaatgcattaaacttgaaattaactacaaaaagcttctcccccaccaaaaaagaactaaccccctggaaattttaaactattttttaaatagcctttagactaaagaaattaatagaacactttatcaaagtatatgggatttggccaaagctttatttaaagaaaaatatatagccttacatatttttattaacagccagaagatattgcaaataagcacctaactcaagaaaccagaaaaagggcctagtggagtgggtcacgcctgcagatctagctacctggcaggctgacacaagaggatcacttgaggcttcagtgagctatgatccagcctgggcaacagagcga

SEQ ID NO: 11848 - DNA, 463 bp, Homo sapiens
caacatactcctgctctttgttcatttgcttttttgatcctgaagatctgacattgggagagatgggaattcaaaatgatggcaacaattactcagcaatgcagtctgtttttattttctcctacttagttcattgacagtttcctcctcgccccagtttgataatatccctttcaacaacccatagtaccggtgttgcaaatagtttaggaaagcacccaaagctggatgaaattgtgcaaagtgtattctcagcatgtatattcaataccatgcctcttaaaaatgcttctcttaaagggtgcacgctgtagcatgaaatgtgtgcatatttaatgtatcttcctggaatatgctatgtgctaaatatatatatattctataaataaaataataaaatgtacaatagaaatacatatttctgtatgcaaataaatatattatacacaaactcttaatacgc

SEQ ID NO: 11849 - DNA, 559 bp, Homo sapiens
atttaattcagaataagatataataactcttcaataaaatatatacaattgtacaaggcaccctttcaaaggggtaaaggcatactggagggatgggagagatggagaggaaggtgaaataccagggagcttaatgggctgtttggcaactccattttcaccaagtcaaaacatggctttatcttctgccctggacatgttaaaaagtatataaaattttctaataagtttagcatatacagcaggtacacacacagagaaagcataattttttttctttctggatctaccaattgttcaagaatatttagcatacaggtaatggttacaaggtactcattttttaagcagaaaattactgtacccccccacccaaataatctttgcaatctgtgaggatgaaagtacctagtatttctcagaaaccatcaactcctcccaacaggctttaactttttactctccaattatctgaaatgaagtaaagcaacagccttgagaagaattaggaagtatttctaattttctacctcacctccaggcattctcaggattcttc

SEQ ID NO: 11850 - DNA, 700 bp, Homo sapiens
caaaagaccctgttaagaggattaaatacaagccaccgactcggagaaaatattttgcaaaacacgtatccggcaaagaattaatatcagaatacataatgaattttcaaaactcaatataaaaatatctaactggaaagtgggcaaaaccattaataaacatttcaccacataggatatatagatggcaaagaagcatatgaaaagatgcgcaacatcattagctattagggaaatgcaaattaaaaccaccataagatattagtacagaatggttaaaataaaataatagtgataacaccaaatgccaataaggaagtggaggagaaataggatcattgatatattgtttttgggaaggtaaaatggtacagccctctagaaagcagtttggtaattagaaaaaaacccaaagtatgcatgcagttctgtaagataaagtgtctgtccaggcatgcatacaacccagcaattgcatgcctgggcgcttaccttacagaaatgaaaatttataattacattataatttgtacacaaaattcatcacagctttattaatagaagccaaactctctgtgggcttctcacagtgtacccattgccagagtaaactgcagccttgaaccattgctcagcctccttacccatgagctatgaacactgaagcaggttgcacagtgaaaaaaaaaaaaaaaaaact

SEQ ID NO: 11851 - DNA, 599 bp, Homo sapiens
atagacattcagtgacttttatctcgttggccaagaaagggcacatggtccacgctcggaaaatttgaagcagtcctaagacttttaaggaaactattgggaaaaagaaatcgtttcctttacaggttgctgaaagggtaagaggtaggtccagaacttctggcaactatcttgctagcaagtcgggtagggcttgcctgagaatgacaccaatacagaggaaactatagccaagcagtggagagagggagactgagtcctggctctttttttagcccatacatctaataatgtctgaagccagattaacctctggatttttaagttctgtgtgtcaagacattccctttcatttttaagccagtttgagttcagtttttaaaaattatttgaaacagaaagaatcctgaataatacaggtcccttccaacaaaataaaacttgattatactaacatgtactctatatatctagcttggcagatttctagttatttctagtagatttctaacatttctagtaatgctttgatggtagttagatgcagttacttgctgtaagtaattggaaataataaaacctcattgttttaaaagtga

SEQ ID NO: 11852 - DNA, 445 bp, Homo sapiens
ggtagcacacgttaatggtgttgctagctggagataatgccttgacatccacgtgtggctgtcatctaagaggagagtgggaatggctttgaatactagaaaagtacaaaagtgacaagcagggtgttatgtgtataggattgtagtaattaaaaatgatctgttttaccaagccttaacttggcttggtaaagccaaggattaattaaggaataacagtatgaattcccttttttaggggtgtactgagaaagttattgttaaaatcatactaagaaattactaacatataaaggatactatgcttaatttcctgtagaaaccccgtgagcagcatcttcaaaattctcagaatagattttttttcaggaagaaaatgtactaaaagaaacaaattttagaatgacagagatcctgggaattatttggatttgaagtatgttag

SEQ ID NO: 11853 - DNA, 98 bp, Homo sapiens
aacttaaacatcacctctaaagaagttatactttcactgcagattgttctctcaaaaaaggcaaacaacttttgagcatttccagatgtagctctcat

SEQ ID NO: 11854 - DNA, 226 bp, Homo sapiens
tcacttgaccccaggagctcaggaccaacttgggcaacacagtgagatcctgtgtctacaaaaagttaattattagtcgggcatggtggcatgttccagtagtcctagctatttgggaggcttaagtgggagaattgtttgagcctaggaggtcgaagctgcagtgagccatgattaactcacttcaccctagcctgtgtgacaacagtgagatctggtcttggga

SEQ ID NO: 11855 - DNA, 580 bp, Homo sapiens
tggagtgcaggtcttaccgtccgagatcgtccgcaactgggcgagctgtgcatggggcgtggctaaggccgtggtttggttacgattggccagcgggacttaagtgttgtctctgaagagcatggacattagtctggagggtcctggaagagtgatccccgccccaccatcaaatggcgcttaggtctaggaagcgggtgtgggtggggccttagggcgaggcgcagacacaccccgaagtggttggattgtataccgcaaggggctggatcgaaccccccaaagacactggaaggctgtgtggctgaggagggcccggcagatccagtgtgtcgtgggctttacaggaaagagctccaccttctctggagtgtgcagatgcgatctaggtgtgtccacccgatgggagctgcgggccgggcagatgctgccccagtacaaagctgatttggacctggggcctctggacttccctgattctctgcttgcatctccagcaaagtcctgtcccgttggctgccttcatccactctctcacttctctgccttcagagtaaaattgcaagatctgtggtgctta

SEQ ID NO: 11856 - DNA, 1201 bp, Homo sapiens
ttcttgccttctcagctgagcttttcctgactagtgaagagaaggcatcacagtgtatttaggggatatttcagttgattgtaaaatgaaagattaattggtttatttatggtaaattaatctggtcttcaaattcttccctatatttttctgtgttttgatgttcatctgcagtgggaaggagaagggtgggaaaagttgtcttgcttgtgtggtttacagatagacataataatttccagggaaaagtgcatggtattatttatctcaggaataggattaaaaaaggaatgtgcctagatcaggcgttcagtgtaccttatggtcatattttaccctgaagttaaatagtcttaaagtactattcagagtgggagaagcggtatgtattcctgaagagtcttcatggtcctgggcattgtgctatgggtaactcttaactcttcactcttaagcagctgaaatctagccatgtttaccttgaggtaagtgaacgctgttccgagtattggtttatcatgagggagcaccattttgtgaatagtttgggaggacaactgaaggattgtcttttttgcatgtttgtttttgaaggcctatctcccattttgttaattcagttaataattgttccttttctgaggctctctaagcttccaaaacaggaatctgctacattttactaaagggccttactattgttcattcagttaataattgttcttttcggaggctaagcttccaaatgaggaatctgctgcattttactaaagtgccttgctaagtggtaactgtggtggcaaaatgatgtatatgctctcaattatatatacctggcacacttgaactaccatgttaggaatatattaaggttgccattaataaaaatttctaacctttgaagtagaattgaaatttaattttatttactccatgtgcacattttcctcgtttagtcagttacttagattcattgaggagagatgtatttgataatgttctcacgttaaacataaaaaaaaagtaaatttgaaatctagcttatagatttggactttattaactcagtcaaaacataaaatgaattgctggaattcacatggtgggaaaagtatcttagaaataagatagtaggcatttgggagcgagataaagaaatattaaaattttcatgtagatttggctcatgttggcctttaat

SEQ ID NO: 11857 - DNA, 1132 bp, Homo sapiens
attattcttaaaaatcctgatccctgaatgctcagggagactgatttgagtaataataaaactactgtctcccacacagccggctctgcatgaattgctctttattgcaattcccctgtcttgagaaatcgcttctgtctaggcagcgggcaaggtgagcccattgggcagttacaaggagacacggagacacagagacacaaagacagacacacaaaaaagagactgtcatgtgaaaagacagacacacagagagaacatcgtaagaagacagaggaggagattggagagaagcaactgtaagccaaggaacaccaaagactgcaggaaaccccaaaaactaggaacagggcatggaacagattctacccatattctcaggaagagtccctgccaacacctggaattcaagcttctggattccagatctaaaaaacctgggcttagataatgattacgccaaaccactggattcaagaaaaagctcgtcatgcccaactattgcatgacagtatgtgagagccaaccgactaaagatattttaggagaataaaatatttggagagcattggagtaaggactgtcattcctggaatggaagcatttaattaaaatgaccataagcctgaagtgactggggcatgggaatatccttgatgagaagatagtgaagcatgtaacaccctgggatagatggtgctgatggaacattttgaggagacccaagttgttggtggaggtgatgggagactcaggacaacagaaagtatgggattttcaatgctgcagaaatggggctgatatggtttggctctgtccccacccaaatatcaccttgaactgtagctcccataattcccatgtgtggtgggagggacccagtgggaggtaattgaatcatgggggctggtttctcccatgctattctcatgatagtgagtaagtctcacgagatctgatggttttataaaggggagtttccctacacaaattctgtcttgcctgctgccatgtaagacgtgactttgctccttattcaccttctgctgcgattgtgatgccacccccagccatgagtgagccaaactcactgttactgtgagtcaattaaacctctttcctttataaatta

SEQ ID NO: 11858 - DNA, 728 bp, Homo sapiens
attattcttaaaaatcctgatccctgaatgctcagggagactgatttgagtaataataaaactactgtctcccacacagccggctctgcatgaattgctctttattgcaattcccctgtcttgagaaatcgcttctgtctaggcagcgggcaaggtgagcccattgggcagttacaaggagacacggagacacagagacacaaagacagacacacaaaaaagagactgtcatgtgaaaagacagacacacagagagaacatcgtaagaagacagaggaggagattggagagaagcaactgtaagccaaggaacaccaaagactgcaggaaaaagatcatccagctcaagttcagtctcaaatgactgcaccccccagctgacaactggactgcaccagaatcaatcacctgaactgctcaccaagtcccaacctaaagaagacatgagaaggtcacttgagggtcatgaaaaaatttgcagaaggaatgaatgccttgaaggacgttgcgaccagctgctgatacccaggaatctggttgctcaagatgttacctgagaataaagaaacgcagacttttccccctcacttccctgaaactgcctctcctttactccttagctacctaaaaactcactgcttcctctttttgttaagatggatttgagacatcttgctctcccaacttcttgctttgaccaaattgaataaatcttgtttgatctccaa

SEQ ID NO: 11859 - DNA, 2040 bp, Homo sapiens
  misc_feature (83)..(83): n is a, c, g, or t
ccgcaagtgctgggatgacaggtgtgagccaccgcccccggcccctcgcccgccttttgaaggagcctttcgtcctcaagggngaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaagtc

SEQ ID NO: 11860 - DNA, 1789 bp, Homo sapiens
taaagcaggctgtacggtccggagtgtatggatggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaagtc

SEQ ID NO: 11861 - DNA, 2088 bp, Homo sapiens
  misc_feature (83)..(83): n is a, c, g, or t
ccgcaagtgctgggatgacaggtgtgagccaccgcccccggcccctcgcccgccttttgaaggagcctttcgtcctcaagggngaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgctaccatccccatttggcagaagtggaaatggagtcccctagaaggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaagtc

SEQ ID NO: 11862 - DNA, 1892 bp, Homo sapiens
  misc_feature (83)..(83): n is a, c, g, or t
ccgcaagtgctgggatgacaggtgtgagccaccgcccccggcccctcgcccgccttttgaaggagcctttcgtcctcaagggngaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaagtc

SEQ ID NO: 11863 - DNA, 1727 bp, Homo sapiens
  misc_feature (83)..(83): n is a, c, g, or t
ccgcaagtgctgggatgacaggtgtgagccaccgcccccggcccctcgcccgccttttgaaggagcctttcgtcctcaagggngaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgagcgacatctcaggttggtgaagataatgcatgctctgagaatgcctgtgggcacacactact

SEQ ID NO: 11864 - DNA, 1489 bp, Homo sapiens
ctcattactaacaacatctcccccgcatcccccttccaaacaacatcggctctggcctggcactgctaggcatggcgaccgtgctgtgtgacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaagtc

SEQ ID NO: 11865 - DNA, 1687 bp, Homo sapiens
cgctggtacggtccggaagtgttatgatcgactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacgacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaagtc

SEQ ID NO: 11866 - DNA, 1650 bp, Homo sapiens
  misc_feature (83)..(83): n is a, c, g, or t
ccgcaagtgctgggatgacaggtgtgagccaccgcccccggcccctcgcccgccttttgaaggagcctttcgtcctcaagggngaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcggacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaagtc

SEQ ID NO: 11867 - DNA, 1467 bp, Homo sapiens
  misc_feature (83)..(83): n is a, c, g, or t
ccgcaagtgctgggatgacaggtgtgagccaccgcccccggcccctcgcccgccttttgaaggagcctttcgtcctcaagggngaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggta

SEQ ID NO: 11868 - DNA, 340 bp, Homo sapiens
cctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaaccc

SEQ ID NO: 11869 - DNA, 1000 bp, Homo sapiens
  misc_feature (83)..(83): n is a, c, g, or t
ccgcaagtgctgggatgacaggtgtgagccaccgcccccggcccctcgcccgccttttgaaggagcctttcgtcctcaagggngaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaagtc

SEQ ID NO: 11870 - DNA, 2126 bp, Homo sapiens
caggcaccgcgtggttctcacaaccagcagctcggctcactgagacccggtggtccagacgctgctcctggctggggtggcgctgcagggagaaccgcgagctctcaggggtcggcgggtgacttctttccggaagaaagcgaggaacgcgctctgcggggtgagccggactccccaactccggacgatcagcccaggactgagagccccgaagtccccaaccacaagtaagcggccccagaaggacaagtctaggtcgccgtccagagcgccatggccgcgcccgcccttcgtttgtgccacatcgccttccacgtgcccgccgggcagcccctagcccggaacctgcagcgcctcttcggcttccagcccctggcttcgcgggaggtggacggctggcggcagctagccctgcgcagcggcgacgcggtctttttggtgaacgagggcgcagggtctggagagccgctgtacggcctggatccgcgtcacgccgtgcccagcgccacaaacctgtgcttcgacgtggcggacgccggcgctgcaacccgggagctggcagcgctgggctgcagcgtgcctgtccctcccgttcgcgtgcgggacgcgcagggtgccgccacttacgccgtggtcagctcgcctgccggcatcctcagcctgaccttgctggagcgcgctggctaccgcggacccttcctacccggcttcaggcccgtgtcctctgcgcctggccccgggtgggtcagccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggcccggcacaaggggccaggcctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaagtttctgcttcaggtcttcaccaagtccctttttactgaggacactttcttcctggagctgattcagaggcagggggccactggctttggtcagggcaacatcagagctctgtggcagtccgtacaggagcaatctgccaggagccaggaagcctaaggatgcccagggctgggtgcagccagctgtcctgcagctctggggagaccagcacagaactgaggaacatctgcaggaggcccaactagtgaaaggctttgcctccggggggcaggtgtgacttccatttcatcagtgcctgccagaagctgtgtctctcattgggctccaaagaggtgggattttttaaaactaaaacatttcttatatacagtctataataaatatgtaagatacaaagaacaataaaagaattacacactaggaaatagaacataaccaatactttcgagtcctccctgtgtcccgctgtgattctatttcctcccacccactcctcaaatcctgtcattattagccctttgcttttctgtattgtttcactccgtatgtaacataaccctaaataaattatttcgtatttgaggtaggaatttaaaacagaacaaatcttctcctgtgcttcctctccccctagggagcgaccactcaggtggggaggggctgggtgagagttgagcccaactacctactccagagtgatgccaccactccaattagagctgacctgagacgtaaacagagggtgttgtgtgtcagccactggcaggttctccctgtagctgccttgcctttctcctgggggttggagggcagatcagtctggacagaacacccccactccaaccccatctgcccggggctggctgggagttcagccagagaaagtcagaacc

SEQ ID NO: 11871 - DNA, 1655 bp, Homo sapiens
caggcaccgcgtggttctcacaaccagcagctcggctcactgagacccggtggtccagacgctgctcctggctggggtggcgctgcagggagaaccgcgagctctcaggggtcggcgggtgacttctttccggaagaaagcgaggaacgcgctctgcggggtgagccggactccccaactccggacgatcagcccaggactgagagccccgaagtccccaaccacaagtaagcggccccagaaggacaagtctaggtcgccgtccagagcgccatggccgcgcccgcccttcgtttgtgccacatcgccttccacgtgcccgccgggcagcccctagcccggaacctgcagcgcctcttcggcttccagcccctggcttcgcgggaggtggacggctggcggcagctagccctgcgcagcggcgacgcggtctttttggtgaacgagggcgcagggtctggagagccgctgtacggcctggatccgcgtcacgccgtgcccagcgccacaaacctgtgcttcgacgtggcggacgccggcgctgcaacccgggagctggcagcgctgggctgcagcgtgcctgtccctcccgttcgcgtgcgggacgcgcagggtgccgccacttacgccgtggtcagctcgcctgccggcatcctcagcctgaccttgctggagcgcgctggctaccgcggacccttcctacccggcttcaggcccgtgtcctctgcgcctggccccgggtgggtcagccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggcccggcacaaggggccaggcctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaagtttctgcttcaggtcttcaccaagtccctttttactgaggacactttcttcctggagctgattcagaggcagggggccactggctttggtcagggcaacatcagagctctgtggcagtccgtacaggagcaatctgccaggagccaggaagcctaaggatgcccagggctgggtgcagccagctgtcctgcagctctggggagaccagcacagaactgaggaacatctgcaggaggcccaactagtgaaaggctttgcctccggggggcaggtgtgacttccatttcatcagtgcctgccagaagctgtgtctctcattgggctccaaagaggtgggattttttaaaactaaaacatttcttatatacagtctataataaatatgtaagatacaaagaacaataaaagaattacacactagg

SEQ ID NO: 11872 - DNA, 978 bp, Homo sapiens
caggcaccgcgtggttctcacaaccagcagctcggctcactgagacccggtggtccagacgctgctcctggctggggtggcgctgcagggagaaccgcgagctctcaggggtcggcgggtgacttctttccggaagaaagcgaggaacgcgctctgcggggtgagccggactccccaactccggacgatcagcccaggactgagagccccgaagtccccaaccacaagtaagcggccccagaaggacaagtctaggtcgccgtccagagcgccatggccgcgcccgcccttcgtttgtgccacatcgccttccacgtgcccgccgggcagcccctagcccggaacctgcagcgcctcttcggcttccagcccctggcttcgcgggaggtggacggctggcggcagctagccctgcgcagcggcgacgcggtctttttggtgaacgagggcgcagggtctggagagccgctgtacggcctggatccgcgtcacgccgtgcccagcgccacaaacctgtgcttcgacgtggcggacgccggcgctgcaacccgggagctggcagcgctgggctgcagcgtgcctgtccctcccgttcgcgtgcgggacgcgcagggtgccgccacttacgccgtggtcagctcgcctgccggcatcctcagcctgaccttgctggagcgcgctggctaccgcggacccttcctacccggcttcaggcccgtgtcctctgcgcctggccccgggtgggtcagccgcgtggaccacctgaccttggctgacccggagtcccaactttgcgctggtcccgctgctggttttgcatggcgtagccggtgagtccgagtggtggatgagggtggttgggtgggtaagcgtgccggggggtgtccttttttgttgccccgggcaccgctgtgttgcccagggggcgggtccctggcaggggagttttctcctatgggtctcagttttgctcgggcc

SEQ ID NO: 11873 - DNA, 1685 bp, Homo sapiens
caggcaccgcgtggttctcacaaccagcagctcggctcactgagacccggtggtccagacgctgctcctggctggggtggcgctgcagggagaaccgcgagctctcaggggtcggcgggtgacttctttccggaagaaagcgaggaacgcgctctgcggggtgagccggactccccaactccggacgatcagcccaggactgagagccccgaagtccccaaccacaagtaagcggccccagaaggacaagtctaggtcgccgtccagagcgccatggccgcgcccgcccttcgtttgtgccacatcgccttccacgtgcccgccgggcagcccctagcccggaacctgcagcgcctcttcggcttccagcccctggcttcgcgggaggtggacggctggcggcagctagccctgcgcagcggcgacgcggtctttttggtgaacgagggcgcagggtctggagagccgctgtacggcctggatccgcgtcacgccgtgcccagcgccacaaacctgtgcttcgacgtggcggacgccggcgctgcaacccgggagctggcagcgctgggctgcagcgtgcctgtccctcccgttcgcgtgcgggacgcgcagggtgccgccacttacgccgtggtcagctcgcctgccggcatcctcagcctgaccttgctggagcgcgctggctaccgcggacccttcctacccggcttcaggcccgtgtcctctgcgcctggccccgggtgggtcagccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggcccggcacaaggggccaggcctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaagtttctgcttcaggtcttcaccaagtccctttttactgaggacactttcttcctggagctgattcagaggcagggggccactggctttggtcagggcaacatcagagctctgtggcagtccgtacaggagcaatctgccaggagccaggaagcctaaggatgcccagggctgggtgcagccagctgtcctgcagctctggggagaccagcacagaactgaggaacatctgcaggaggcccaactagtgaaaggctttgcctccggggggcaggtgtgacttccatttcatcagtgcctgccagaagctgtgtctctcattgggctccaaagaggtgggattttttaaaactaaaacatttcttatatacagtctataataaatatgtaagatacaaaggcccatgaaagagttgctccctgggggataggctgtggcccgataatctcaaaga

SEQ ID NO: 11874 - DNA, 893 bp, Homo sapiens
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaagcaggccctcatgctgtaaagaagttgagttctggaaactccaagttatcatcatccaagtttagcaatcccatcagcagcagcaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataacttttaaataaaccttggggggtgatggagtcaaaactgcctgttaca

SEQ ID NO: 11875 - DNA, 759 bp, Homo sapiens
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatcaggccctcatgctgtaaagaagttgagttctggaaactccaagttatcatcatccaagtttagcaatcccatcagcagcagcaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataacttttaaataaaccttggggggtgatggagtcaaaactgcctgttaca

SEQ ID NO: 11876 - DNA, 431 bp, Homo sapiens
tttatcgctgtaaatccatattgtgcaaggtattagtgctggggatgcaaagataaattagatattatctctgcctttgagaggcagctgatggtttaacaaagaataacaaacagctaggtaactatattataagtattaaaacagggcaggcatggtggttcatgcctgtaatcccaacactttcaggggctgaggcaggaggattgcttgagcccaagagtttgagatcgtacggggcgacatagtgagacctcatgtctactaaaaataaaaataaaaaaatagttgagtgtgatgacatgcacttgtagtcctaactacttgggacactgaggtgggaggatcacttgagcccgggaggtggaagttgcagtgagcagtaatagcaccagtgcactccaccctggcaacggaacaagatcctgtct

SEQ ID NO: 11877 - DNA, 949 bp, Homo sapiens
ccccattttaaagacaggaaaatgggctcagagaaggatcaacttgcctgagcacaacagggccacagcctgtctcccagcccccagatcaggccattgaccaagctgaggatgcagagctgggatccttgccctttgttctgtgttgtcccctggatgtgatggttccttggaactgaagagggcctggactcagtggcaggcatacactccaggccccagtgccatcagtcacacacaggagctgggttagggacggggctttactctctctcgagtgagtgtctccagtaggctatgccatgaggggagggtctgttagaaccaagatgaggaagaaagaaagggagagagagcagttccaagccagagttgttgaacaacaaggccaaggttgcagaatgaggcaggggtgaatctgagaccagaacccaggctccaggttccaggcttccacgtgagatgcgcaaatatttgagaatcttgcactgtacaggctccaggctgtatttgtccccagccagcttcaacttgtctatctgatgggctgagtgtctatatgagtgtccttggcagtgatgacccagtggactgcccagccccagaagagctggctgtcacctgtgtgccaggatcccagtggccaaagggcaggggcaccaggaagtgagaggagagccgggacctgggaaatgagtgttgactgtgtctgaaaccgagtgtgggggccgcagccatccttgccccatgtccttctgcagaataagagtaaacaggccttctctagccatgtttgatgcaagatggcccacagctgtgactttttagctttatgtacatagtctttattataaaggtaacatatatttactggaattaacccaaacactacagaaaatatgtaaacatttacaattaaaaatgtgtctactctttgaactgcaatgct

SEQ ID NO: 11878 - DNA, 483 bp, Homo sapiens
tcccactccacgtcctgtccaatacttggcattgtgagtttttcccattttagccattctatgagtatgccgaggtatcacaccgtggttttaattttatttctcagatgacgaatgcagttcatttttttaccaaggatattttggacctggaaacattattcaacaaatttgaaaatttcctttcgtccccaaattgtagaactcacttccatccccacattgtggaaacgtctggcagtgcttctgatttcttctgggcgggtttgaatctcccaggctggaagccaagggatggagtagacaagagtttctctggatgagtctggggaactggccacctgccccagaatcacgtgggttgctggtcagagatgcaggtgctgagccctggcccagccccggactcatcagacagcccttgacccattggtccttctagggctgttttttttttttcttgtcacgaaaccaaaaaaaaaa

SEQ ID NO: 11879 - DNA, 339 bp, Homo sapiens
gcagtggggatagagggccagggaggcaaggactttgtttgtgcagtggcctcaggatgggggtgaatttgcaatctcagccctgaccactctaggctggcagggacaccaggctccctgggactgattccctgggtgagacggggcagggaactgactcctcacaaaggcccctcctaggagcactgccttaacaggtaaaaccaggccccacctttagattaaaagcttcttctttaaatgaaaacactttggctgggcgtggtggctcacacctgtaatcccagcactttgggaggccgagatgggtggatcacctgaggtcaggagttcgagagc

SEQ ID NO: 11880 - DNA, 460 bp, Homo sapiens
  misc_feature (85)..(85): n is a, c, g, or t
  misc_feature (101)..(101): n is a, c, g, or t
  misc_feature (318)..(318): n is a, c, g, or t
  misc_feature (325)..(325): n is a, c, g, or t
  misc_feature (428)..(428): n is a, c, g, or t
  misc_feature (447)..(447): n is a, c, g, or t
ttcctccctggggtaactggaggtccctggtgcctttactcaggcagtgctgcctcacccactccattccttgtccccgtggctncctgcttgcagcagtnagaacctgcagccccccaagccctcagttattccacggcccctgtgcagtcactggccccacaagtcacccatcctgggccctggcgtgctctctccatccatcctctctgtcacctctgtgctggtttgctcctatctgcatgtcaacctggaaatggctgttgctttgtagagaccctctttccctgacttcagagccaattcctttgctgctgngcagagnctgacatttgaaaccaacaccaactcacaaagcagctcctcctttccagaagctgccccactgtggatgggcgagtggcccgggctgtcggctgtggcggtgntacatgaccgctctgagcntcccacctgacgg

SEQ ID NO: 11881 - DNA, 1355 bp, Homo sapiens
aaatatccaaactatatcactcctctctaaaccagtttagagggttcaaactttgccttctccagatttgcctcttccctgagaccttccctgatagcttcccacacatactgctctccccagtccatcaatgaattcctgcatccaggtggctaatggttccatacttacccttcagctgtgaccagttttgtgtccacctctgtcttcctccctctttttgcttagatgacacccactcaacctctagatgtcccctgctacaggtgggatgcccttgttatatgttcttatagcaccacctgtcttcccttcatggcacttatatttgtaaatgtattcatgccatagagtactgcatgaaggcagtcgagtgggtggttcaaacgtagaccctggtgtcagcctgcctggactagctatatgaccttgggcaagtttcttaacctctctatacctcaatttccttacttatcaggtgaagatattaagagtacctcctcagagtgtgattttgttaatttatgtaaagtactgagaacatgcctggcatgtaataggcactgtataagtgatatctattattattgtacatgggattatttgatgtctgtatcccatcccccatcagacatgaaaaaataggtctgcttttgatcaccattttacacttaaagaaaagggtcaggctgggcatggtggctcacacttgtaattccagccctttgggaggctgaggcaggtggattgcttgagcctaggagggagggagggaaagaaaggaagaaagaaagagagagagggggagagagagagagaaagaaagaaagaaaagaaataaaagaaagaaagaggaaaaagggaaggagggagggagggaaagagaaagagaaaagagggagagagaaagaaaaagaaaagaaagaaagaagggagggagggagggaaagaaggaaggaaggaaggggaaggggaaggagaggtccataggagtagccaataaattgaatactgaatatttggacaattgcctctctctaagtgctctagaagcttctagagggaaggaatcttgtcttatacattaaaaaaaaaaaaaaaaaagtcttatccagtctgaagtacggtgcctggcacattaattcctttcctcttttcccctcactgccaaatgagctattgccactcacttgatatgcaaacactggctgtctagtatggaaaaatatttttctggctgtagacttgagtttgattaccaaattgatttctgtgaattacatttcaattctgtgcagaactttttgacagccctttaatcaccatgtatccaataaatatttattaaagacata

SEQ ID NO: 11882 - DNA, 522 bp, Homo sapiens
agatatttatttttgtatgaaccaataccatcagcatcagagaagccataatttaattatgaaggactatatattataataagttataacacttcaaccagttttcatgtttgtagttatgggcacactataataatttccttcagtaagggtaaacaccagtgaagcaagttaaaaacagaataaataaaaaaactatattcaatgaaactactagatgcaacccacatttccagtaatcctggagaatagtaagcattaagcttaagatctggaacatctcattcagtgtgctttactgtaggatatcttacttgaaaataataagaataatgtcactcaatagcattttagacttgttgattatctatgtacatataaatctggtctaaatgttgaggtaaaaatccgaattaaaacttgctgaggctgggcacaatggctcacacctgaaatcccagcactttgagaggccaaggccagaaaatcgcttgaggccaggaatttgagactagcctgggc

SEQ ID NO: 11883 - DNA, 1730 bp, Homo sapiens
cagaggcactcctcacctcccagatggggcagctgggcagaggtactcctcagttcccagatggggtggcggccgggcagaggtgctccccacctcccagacggggcagcggccgggcaaaggtgctccccacctcccagacagggcggccgggcagaggcgaattttttcttaatatcttaatattttatgtcatttgtgtacaaaatgaaattctggcttttaataatagtacattcttacttgtttcatcctatagaatacatacaactgtttcaaaattatcataccaaaattattattagcaatattaaaatagctatgctagctttctttggttatgttagcatgttatggtatatcttttcccactctttttcttttaatcttataataagtgtatatttaagatgtgtctcttgatagcaacatatacttgagtttgcttttcatcatccagcctgacaatcttttatcttttaactagagtacttaatcttacttactgtacttactgatatgttgggtttaaatgtaccatattaatctctgttttctatttatcatatctattcttgttcttttttatcttttcctggtttcttttgcattatttctatttcattttcacccctattatgttgttagttatacattctaattctttcattgcttaccctagagattataacatgcatccttgacttattgaactgtaatgtaaattagtatattcatcattccccagacaatgcaaagacctttgaatactttaagccttatttatctctcttctgcttttgtgttgcttttaacacacattttaattctatttatatttgaaacccgatgaaacatttttaatttgtttatatttatttatatgtaccaacatatttaccatttatttccagtgtccttcaattcttcctatatttccatgcttccatgtgggataatttttcatctagatttagtatttcttccaatgcagatctggtagtgatgaattctctcagtttttatttatctgaaaacgtctctttctctttcattctttgaaggatatttttgctgggcatagaagtttggatggcaattattttctttcagcactttgaagaaattattgtcttctgattttactgtttcaccatacttcccttctctctgcaatcttagctcatcaaatccttgatgtcttcaaatagacttttctccctctctagctcttctagtagttgttggtgagaggttggtctgataaaagtaatctaccctggctagacatctgctgctaataataaacctactaaataaagtttaagatttatttgcaattttttttaccttagaatttatcccatgagaaatgtagaatcaggttactatattcaaaaattacttgacataattatttttaaaaattttaaaaggtaagaaacaacctttttaaatttaagaattaagagactaagaaattgagaattatttcaaaactcaaaaaatgttgaaggctttaaaaatgagtaagataaaatgtaaggtaaatgaaatgaatgtaggcattttgaagattagaaatttagccgtaggtaaagaatacaaaggaaaaataattttaaaatcatcaaccagatcaacaaaatatatgttaatgccgagactttgaattagagtgcgaattgtatcttaattaaaaagagaaaacccaaaactggaaaaaaaaa

SEQ ID NO: 11884 - DNA, 439 bp, Homo sapiens
gcagacttccgtctgcaagcacctagagggtgactgtcctcttgaggcagtgccagagatgaccaaggggtgggataggtgggcaggaagagtgggtcccatctgaggaatgttctgagtatttggagagagagggagcagcccatcctctgcttgtcggaaaaggctgaaattccatccccaggccccaagcctgcggcaaggcaagggcagaggttgggctgtggagctagggattcctggcctcggaaagcgggtaggaatgatcaaggatggtggagggcccgcggtggctgagaaccaggggtcttaggaccaggccctcctacccagttttcgatcacttattcgtctctcttgccctgtccctgttacctaacctcactcaatgttctacctctttctagaataaaccctgactccctccaaaacagagctc

SEQ ID NO: 11885 - DNA, 507 bp, Homo sapiens
tcatactctggtcagaatgacctgctgtagaactgagagaactgtccttctgtatttactatgctgacagaatatgcattaaaacatctatacatctacaacaatgtgacatgtgctaagcaaagagagagcaaagaccaaaatcatatatcatgatcaatgacaattgactagggtaatatcttatgaagagaaactttaagggaaaactttatccctttgatgttaggaatagaaatggctttttgccttctcatagaatcttagcactggaaggagactcagaaattatagcatactataagggttggccagctatggtttacaggcaaaatctagcctgggatgcctgtttttgttaataaaattttatggaatattcgtgctcatttatttgcatatcgtccatgtcagctaatggtagaattgagtagccaagaccccatggcccacaaaaccaatcagactctaattcattttatatatttcatagataaagggactgag

SEQ ID NO: 11886 - DNA, 457 bp, Homo sapiens
ttttccaatgtatattgtcatttaatctgataggtaatctgctataaaactatttttcaccctcatacaactcatagtcattaaactgaaacttctttcagcttctgtaccagactaaacacacttctacgtttcttgttcattactagtactttctccatcactgtaagtctagacaatcaacaaaacaacaaatcaaagtcaaactgatagtctttgctggattccatggtgtaaagagtccctgcatgattgatttcaagctgccagcgtgacgccactgcaggtggtgctggggagacgtgcattatcccccatggtgcagtatctctcccccaagccccacacagacactgttggtgtcaataactccagagcagatgtaatagtaagcacagtcaaataattaggaatggctggatttggatatttagggcctttgtttttttaggtttgt

SEQ ID NO: 11887 - DNA, 422 bp, Homo sapiens
tattttttattatgtttttgttgttgttgagatggggccttgctatgttgcttgggctggtctcgaactcctgggctcaagcaatccagtctccttaaaatcactctacacctctgctctaatccaccatgggctcagtgccatgatgggaaccttacccaagcgcttgggttcctttatggtgaaaaagggacttcttgctattgcccccatggattatccacaaataagatgacatctttaatctttacattgagaattaagtgatcaatatcttcacagaaattataaatctgattattgaaattaagcaaatcacttcaatgtgcattctaactctattcagaagaaaaaaacctggctttcattgatagtgataaatattccagattattcatttcattctgaatttttgtaattta

SEQ ID NO: 11888 - DNA, 536 bp, Homo sapiens
tttttttttttggcttttccaaaattcccttctttcaccattttgagttgaaaagtcaagataaatatttatgctgtataataacccacctctctgctacagcaaccacaaatgtcacaggttcctaaagcctccaagaatatttgttttacagcaagaagtagttgctttttctaaaaaaaacacacaattttctcctccaggatagacaatgggtaaaaatctagctgttaactactagccagagttatgggaaggaaaagaatccctcctttttctctcaaccagttttcctttctaacccacttcctttgccaactgctgatgaggcatgtctaattttgcagagtgatactagaacagtgagaggcactgccagctccttcttccccggtccaaagcacctccttccctgaaacacaaccttacaactgcaagtattagatgtcacagcgagcaagcctttaggagattattttaaaatgaccaaatatacaccagtaagagaaaacttctgaaaaactgctctgttatgc

SEQ ID NO: 11889 - DNA, 413 bp, Homo sapiens
actctctgatttcaccctccacccaaccaattggcattccccattccctagcaccccgcctgccaagctatccttaaaaaaatcctagcctccaaattttcggagaggctaatatgagtaataataaattcctatccttccgcttagtgagctctgcatttattaaactctctgttgtgaaaacttgctgttctcagtgccccggcttttctgggcagtgggtcagatgaacccattgggtgatgacattatgactaggttatactcattgtggctagactatactcattccttcaaagatcataaggagtcccaatggtaagaggaaaattttctttgttctctaccatctcctcccagcctctgtgctgatttaaaaaacaaaacaaacaacaacaactaaaaacaatgca

SEQ ID NO: 11890 - DNA, 280 bp, Homo sapiens
tagctgtacaattaacgctaggcaatatagagagctcaataaatacctcctcacttgcacaccaaattccaataccatttgaaagatataagaatcatacaaatggggattaaaacatcaactatattttaagcatatgtgagaatgtggctttggattctctttcaaatggattttctaatactttcctctctatatctcaacccaatatattgatttacgtaggcatgggaagtgctgaattgcaggaaaaaggctacctatcctaataaacttacca

SEQ ID NO: 11891 - DNA, 648 bp, Homo sapiens
cacagtggctcacacctgtaatcccagcactttgggaggtcaaggcgggcggatcacgaggtcaggagttcgagaccagcctggccaacatggtgaaacccgtttctactaaaaatacaaaaattagccaggcatggtggcaggcgcctgtaatcccagctagccaggaggctgaggcaggagaatggcttgagcctgggaggtggaggttgcagtgagccgagatcatgccatggcactccagcctgggcgataacagcaagactccatctcaaaaaaaaacaaaaagtctgtatctgggcaagaaaaataagtcctttcaatgtgtctagtttataaacccatttaattcatatttactggttctatattttagtaaataattaccaccagctccctctatatagtatattaccaaagacaagtctaatttaacatttatatgctattcattttttcttttctttaaaaaattttttttaatagagaagggttttcgccatgttgcccaggctgctttttaactcctgggctacattgcgaaacctgttctctacaaaaaatacaaaaaattagccaagcatggtgatgcacacccgtaatcccagctacttgtgaagctgaggtgggaggatcacctgagcccag

SEQ ID NO: 11892 - DNA, 663 bp, Homo sapiens
cacagtggctcacacctgtaatcccagcactttgggaggtcaaggcgggcggatcacgaggtcaggagttcgagaccagcctggccaacatggtgaaacccgtttctactaaaaatacaaaaattagccaggcatggtggcaggcgcctgtaatcccagctagccaggaggctgaggcaggagaatggcttgagcctgggaggtggaggttgcagtgagccgagatcatgccatggcactccagcctgggcgataacagcaagactccatctcaaaaaaaaacaaaaagtctgtatctgggcaagaaaaataagtcctttcaatgtgtctagtttataaacccatttaattcatatttactggttctatattttagtaaataattaccaccagctccctctatatagtatattaccaaagacaagtctaatttaacatttatatgctattcattttttcttttctttaaaaaattttttttaatagagaagggttttcgccatgttgcccaggctgctttttaactcctgggctcaagcaatccacccacctcagtctcccaaagtgctgggattacaggcgtgagccactgcacccggcccccctattcatttctaatgtcccattcagtgcatatgataagaaataagatgatttgcagaa

SEQ ID NO: 11893 - DNA, 333 bp, Homo sapiens
caaaactttacttcagtttagcacctttttaaaaatcacttgtattagtctgttctcacactgctataaagatactactcaagactggttagtgtataaacaaaagaggtttaattgactcacagttccttatggctagggaggcctcaggaaacttacaatcatggcagaaggccaagaggaagcaggcttcttcttcacaaggtggcaggagagggagagagctagagtgagggagtgccacactttaaaaccattagctctcctgagaactaattcactatcatgagaacagcatgggggaaactgaccccatgatccaatcacccccac

SEQ ID NO: 11894 - DNA, 566 bp, Homo sapiens
ttcttggtcctgggataggaggaaaaaagaaaaatgtatcaaaaacacacaacctggtgggagaacccaaccctttctgccagaaggaggcagagaagggaataagaggtcaaggaggttcggtccttctattattacccccaccatgcgcacaacagccccctcctgcgtaagtggggcaaaacagcgcaaaatacatatctggggccaaaacccatgtgaaaggcaaaatctggaagggagggggcctaaggacaccgagcctgctcccgggaagggaggggggaagggaaaacgttgcctcgacgccagcaagggatttgtattccctcctaaatttgcccacccagcgtcatccccgtcactccaagtaccaattcagaggtaaggggcggctcacgtcaccgctgggccgatatcgcccacatttgccccaagcagttgccctgggcctgaggtttgcccccccctgcagtcggcgaccggcagcgctgcctccccgtccgccattagagacccagccaaacaatacgtgcggagcaagagcccgcagcgcagcgccgagg

SEQ ID NO: 11895 - DNA, 818 bp, Homo sapiens
cagcttgcagagcactgccaggaacatctccattaggctttttgtgagtgagaaacactcataagatactgtgctcagccaatgagagcttggggttatttgatcctgcatagcctattctattgcaaatgatatgaaaatcaggagtgggtttctgctgtagccaaaaaacagaaaaaacaaactcttgttggctaagcagctgcgtggcaggcaaaaagaatacagctcataagctggacagcaggagatctatattatgcaagtacaagacatttgctaagactctcatgctaacttgggaggcaggttatgtgccccagagacagcagctctaggggaaagggacaggccagataggatgtgcagtgtgagttggctactgttgactgcattttggaatgctatcacagtaaggaggaaagaactggctagtttgcaagcagaaatgaaaggcaacaatctaaaaaaaattagcatcaaaaggttgcaaaagactttctcaaactctaatgagaaaaggtaagattcaaaattgctttcagcaataaaggcataataaaacttctcatctgaacaaaataacttggtcttttggtaaatatggaattaagggggtggctctcccatcatgatcccagatggcctcatggtagctaccattaaattgagagaagcatggaggtaaggcagcaaggaaataaggcagcttatgtctaggaaagaattttatgtgtgtgcttgagttgtccattgctgtgtaacaaattaccccaaaactttgtcacttaaaaccactatcatttatcactcatgat

SEQ ID NO: 11896 - DNA, 462 bp, Homo sapiens
gccgagaccccacctctactaaaaatacaaaaattaactggacgggtgctgggattacaggtgtgagccactgcaaccgaccagttgaattttttttttttaatcataaaagtgtgttgaattttgtcaaatgcttttcctgcatgagatgagagggtcatgtggtttccttcctccactctgctaatattgattgattttcatatattgaactatccttgcattccaggaatgaatcctgcttggttagggtgtagagtcctttaactatactgctaaattcgttttgctggcattttgttgaggactttcccagtgaggctcatcagggatattggcctgccatttctcttgtggtgtgtttgtctggctttaatatgagggtaatgctggcttcctaggatgagtgaggaaatgttcttcaatttgtccaagagtttgaggagtggtactgattcttct

SEQ ID NO: 11897 - DNA, 306 bp, Homo sapiens
tcatcctcaggtggctcattgagcatcttggctgtatttcattttagagatgatatgttttgagatggagacttttcccccaagttctccactgctagccatctaatctccaaacagaccaatctctctaccccagaacttcttttccccagggagcctggtggtgcagctgctccatggagaacacctgttttctctttgacatctatcttattagaacacagtccgtgggtactggagggtcttagggctgccactatttactttgtggagaagtaaaaaccacagggagactgccctgcaagt

SEQ ID NO: 11898 - DNA, 283 bp, Homo sapiens
actcttaaaccatgccctaaccaaattctgcttttgccatttaacagctcatgagtctgaacctcagtctcttctgtaaagctgatgcaataatccctacctcaagggccgtgcacatgcagagtgcaaggtgcacagtaaacattcagcaagcagtggcagctcacactgtcacagttctagataccaggtctggggatctggattctaaaacccagttctgttactaacttgcttgggaccttgggacattctcatgtttctctgagcctcagtttcctca

SEQ ID NO: 11899 - DNA, 404 bp, Homo sapiens
gggttaattttttaggtcaagattatgaatgtaattgctcttttttgtgttcataactcaacagtttaatttgggaggattttatgggtatcttggtatatttgaaatctctgacctttttgaggatgtttcttggtgcattttctagacaaaatcatcacctgcaaaaaataggaatttagcagtacgcttttttctcttctgatgtcttttaagtgtggtgagagtgtagtcctgccttctccttttaaggggagagtgggtaactcaaatgcatcttcatttaccaatgcttctccattatttattaatgcattccattatttgttatgtttgcttttgttttaaatctatccaggtaagatttactctattgatgctctttttatgacataaagaaaaaa

SEQ ID NO: 11900 - DNA, 417 bp, Homo sapiens
cttcccattgatttgaaaaaccgcttttgtcatatactaaattgttgcatgcctttaggtccatttttggagtttggtagctttgatgtgcatatgattttgatttataagctgcagatctgtggagctctgctttttgcttttggtattttgcttagaacagcccttcccacatgaaataataaaaatatacctgtatttttattaaagttcttttttattgaatataataattatacacatttatgggatacatgtgatattttgatacaaggatagcatacaatgtataatgatcaaatcagggtaattaggatgtctgtcacctcaaacatcattttttgtgttggaaacatttcacatctcttcttctggttgttttgaaatatacaataaattattaactgtagtcatctt

SEQ ID NO: 11901 - DNA, 541 bp, Homo sapiens
cagaagctgtgccaaatccttctgtgaaaacttcctcaaagctggcggtttgaggttagagtttcaatgtaatgttacatgagttgccgaaaatgaatatagttattttagttaatttcccctgcaaagtcttgcttattcctacaaggtatcatatgactcattgtgagagttattataagaaggaatgatgtttcagtcctttaaaatattttaaatcattttataacttctgattatttgaaaaacgtatggaagcatgtctctttcccctctggtagtgggggaaattttcaagaagagtagaagccaggaggctgtatctgtttcttttgtgtctcatgtcagtttgaaataaggtgaatttgatcgctgtaaatccatattgtgcaaggtattagtgctggggatgcaaagataaattagatattatctctgcctttgagaggcagctgatggtttaacaaagaataacaaacagctaggtaactatattataagtattaaaacagggcaggcatggtggttcatgcctgtaatc

SEQ ID NO: 11902 - DNA, 404 bp, Homo sapiens
gaaatctaccaattaccaaaaaagtaattcaaaataatgatcttttaaaaactcaacaaggccaggtgcagtgactcacacctgtaattccagcactttaggacaccaaggtgggcgagtcacttgaggtcaggagttcaagacccgcctggccaacatggtgaaaccctgtctctactaaaaatacaaaaattaactgggtgtggtggtgcacacctgtagtcccagctacttgggaggctgaggcaggagaatcacttgaacttggaaggcaaagattgttgtgagccaagatcacgccactgcactccagcctaggtgacagagtgacactctgtctcacaaacaaacaaacaaacaaaaaaccctcaataggatacaagataatacagaaagataattca

SEQ ID NO: 11903 - DNA, 838 bp, Homo sapiens
atggctcgcactaagcaaactgctcggaagtctactggtggcaaggcgccacgcaaacagttggccactaaggcagcccgcaaaagcgctccggccaccggcggcgtgaaaaagccccaccgctaccggccgggcaccgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttcaagtaaagtagctgtaagaaaccaatttaagacaaaagggaatgcattgggagcacttttcgttttaatgcctactgaaggcttcaaaaccaatcgatttcggccggtcgcggtgactcacgcctgtaattcaagcactttgagaggctgaggcgggcggattaccagaaatcaggagttcgggatcagcctggccaacatggccgaatcccgtctctacgaaaaatacaaaaacacgccgggcgcgacggcgagcgcttgtaatcccagctacactctgaaggctgaggcaggagaaacacttgaacctgagaggcagaggtttcagtgaatcgagatggctctaatgtactccagtctgggcgacag

SEQ ID NO: 11904 - DNA, 795 bp, Homo sapiens
gccttgttttatggaaaataaacacagccttcaggttatgaaaaccagatgtagaagaggacaagtttaaaaaattaaagtccaagccggcgcacgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttcaagtaaagtagctgtaagaaaccaatttaagacaaaagggaatgcattgggagcacttttcgttttaatgcctactgaaggcttcaaaaccaatcgatttcggccggtcgcggtgactcacgcctgtaattcaagcactttgagaggctgaggcgggcggattaccagaaatcaggagttcgggatcagcctggccaacatggccgaatcccgtctctacgaaaaatacaaaaacacgccgggcgcgacggcgagcgcttgtaatcccagctacactctgaaggctgaggcaggagaaacacttgaacctgagaggcagaggtttcagtgaatcgagatggctctaatgtactccagtctgggcgacag

SEQ ID NO: 11905 - DNA, 410 bp, Homo sapiens
gtaataactaactacaaccaggaacagctgggtgtgtttatggggtttggggttttttttagcaagaagctagttttccagccagcaaattttcaatactttcctttctgccacctcctcactttcttcttctgctcttctcattccatagttattgccctcagaacagttcaactcagcttcaacactggaatggtctcattctgctccatcacagaactggggattctaatcctttattattctgtgctccttcctctctctccagaggcaaaaagaatgaaaattggggccgggcgcagtgcctcacacctgtaatctcaacactttgggaggccgaggcaggtggatcacttgaggtcaggagttcgagaccagtctggccaaaatggcaaaaccccgtctctact

SEQ ID NO: 11906 - DNA, 538 bp, Homo sapiens
ttgccgactctcaaaataaaggctcagaggggtgtccaatggaccagaaccattctttcgtgtctatttactgtacctcaacgtgggtttccttatcttaagagcaagagttgtactcaacaaataaaccttgccagttccaaagctggtaaatagcttttgtcaggtccacactgagcctctgaaaagcaatctgctggtgggagctgacagctaagctgtgcgtcttttgaccttctccttatctaggcagagaaaattttcactcatccatgagactgttctttacatttttctggggatcagcaaggtgacaggtggtttgcaaaacccaacatgattattatttttctaaatcatagttgttccagctctagctttcttccccccaatattcacatggattcctgtttaaccaaacctcccacttccactagctaataaaagtgtcatgcagattgttacaaagaactattgttatttacaagtctacgttttctttgaaatcaaaacataataaagtgaattttcagtgtta

SEQ ID NO: 11907 - DNA, 706 bp, Homo sapiens
ttgccgactctcaaaataaaggctcagaggggtgtccaatggaccagaaccattctttcgtgtctatttactgtacctcaacgtgggtttccttatcttaagagcaagagttgtactcaacaaataaaccttgccagttccaaagctggtaaatagcttttgtcaggtccacactgagcctctgaaaagcaatctgctggtgggagctgacagctaagctgtgcgtcttttgaccttctccttatctaggcagagaaaattttcactcatccatgagactgttctttacatttttctggggatcagcaaggtgacaggtggtttgcaaaacccaacatgattattatttttctaaatcatagttgttccagctctagctttcttccccccaatattcacatggattcctgtttaaccaaacctcccacttccactagctaataaaagtgtcatgcagattgttacaaagaactattgttatttacaagtctacgttttctttgaaatcaaaacataataaagtgaattttcagtgttaactctgttattttaaactcatggtagtcttgccaaaccctctggtgaaaagaagtccctgcaggttatgggaactattcccttgtcttttctcaggaccgtacttcaaacaactcaatcaagaggcatctttcaagtttgtaaagatgttcaaggaaggcaattgact

SEQ ID NO: 11908 - DNA, 361 bp, Homo sapiens
ctccatctcctgagttcaagcgattctcctgcctcagcctcccgagtagctgggattaccaacgtgcaccacggtcagctaaattttgtatttttagtagagacggggtttcgctatgttggccaggctggtctcatgtgatccacccacctcggcctcccaaagttttgggattataagcgtgagccaccatgcccagccgcaactttttagaaaagtatttttcaggccaaacacgatggttcttgcctgtaatcccagcagtttgggaggctctcgtgggaggatcacttgaggccaggaatttgagaccagcctgggcaacatagtgagacctcatctcactatgaaaaaaaaatta

SEQ ID NO: 11909 - DNA, 1083 bp, Homo sapiens
ggtaccaagtcatcctcaggtttgataactaatggtgccttctttgatccatcaaagttatgactgaatgtggcaccgggacagttagttgctgtcctagagttaatttgctagcttcttgtgttaacaagatggtggcagctaatgccttaaggcaaagaggccatcttaacaccatggagtctagttgttgggataaatatgccactgggtgacgccatgatcctataagttgagtcagagcccctatagtcattgttttttgttcatgaacatatagaaagacttagttatgtctcatagtcttaaggctggggcctgggttaaagcttccttgatctgtttgaaggctatttcttggttagttttttaaaagaggggctccttttcccctccttttgtggcgtcatataacagcttagccatcagtgaaaaacttggaatccagatgtggcagaatgttgctgcgtctaaaaattcctatttgtcatcgggtagtcggggttagaagtgcacaaatggcttgcttcctctcatagccaaaccagtgttcctcgtggctcaatatgacacctagatatgtaacctcttcatggaaaatttgggctttcttttttgatattttgtaacttgctttctataggagatggaggagatcctgggttccccgataacactcctctcaggttggggcaggcaaagaaagctcgtctatgtactgcaacaaggcacagttgttacttggcacggtataggccatgaggtctgaggccaatgtttctctaaagattgtgggagagaacggggcatggtggtttgcgcctctcatcccaacactttgggcggccacatggctggatcatgaggtcaggagtccaagaccagactggccaagatggtgaaaccctgtctttaccaaaaatacaaaaattaggcagccatggtggcaggcgcctgtaatcccagctacccaggaggcaaaggcaggagaattgcttgaaccgagggggcagaggttgcagtgagctgagatcgtgccactgcactctagccttggtgacagaacaagactctgactcaaaa

SEQ ID NO: 11910 - DNA, 435 bp, Homo sapiens
taaggctattgattcagtcctctgctgagtaaaccatgggtatctccagaagtggacaatttgtttttacaagtatggtacatattaatagtaacaacaacaaaaaagaaaacagtacttatttttctggtgttcctgttttagtattccttgaacaaaacctttatcacttggaatttttattgtctacttatggaaagacttttagacttacgtagacagtatcacatcactcttatgcatacataaagaggaaaaaaatgtttcctataactttgtcacagttagtctgactcttctgaataacttttttaatcccagtagtcaagctcctgtacttttgtaaaatatattaacagtgaattactagaaaatgggccatgttcttgtatattacagtgatgtcaattgctgataaattttctaactgcttac

SEQ ID NO: 11911 - DNA, 1792 bp, Homo sapiens
aggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttgggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcatttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaacccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatagtctttccacattacttttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaatttgta

SEQ ID NO: 11912 - DNA, 1740 bp, Homo sapiens
aggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttgggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcatttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaacccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatagtctttccacattacttttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaatttgta

SEQ ID NO: 11913 - DNA, 1738 bp, Homo sapiens
aggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttgggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcatttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaacccaacatataaggtatcacacaaccaagaaaagtaaaaccattgcaagtttacttgcgttgagtacatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatagtctttccacattacttttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaatttgta

SEQ ID NO: 11914 - DNA, 456 bp, Homo sapiens
tggttttgtttgttgtttaatttctctttaaagtgtgttgctttcctttcccttgatgtctcagcaacagtacttctattcttattagctacttgtattagtccgttttcatgctgctgataaagacatacctgagactaggaagtaaaagaggtttaattggacttacagttccacgtgtctgaagaggtctcagaatcatgacaggagacaaaaggaacttcttacatggtggtggcaagataaaatgaggcagaagcaaaagtggaaacccctgataaactcatcagatttcatgagacttattcactatcacgagaggagcacgggaaatacccaccctcatgattcaattacctcctctgggtccctcctgcaacatgtaggaattctgagagatacaattccagctgagatttgggtggggacatagccaaaccataacaccaccattag

SEQ ID NO: 11915 - DNA, 365 bp, Homo sapiens
gaatggaggacttctttagatagggtaagtggtggtatctcccaggaggagagcacacctcattcatctttgcatccccaggcccatgattcactggcagggtcaccaaggataagctagtcacagtcagaacttttgtttcttcatttcactcctgcatgcattcattcatatatcatcatgcattcaacattgcttgcttgcttactaggtgcctagtagatgcgatacagcagtgaacaaaagaaacaaaaaatttctgatctcatgaagcttaaattctatttggggtgggcgaggaaaaaaaaacaagaaaaatacatcttacacactctgcacatgtaccccagaactaaaaatttttt

SEQ ID NO: 11916 - DNA, 448 bp, Homo sapiens
gatggctagggcaggacacggacagtcatcaggggatctatgtttggcttatggcaagtggcttcactcccacggctcaggtgccattaggggatattaagcccgcttactaaccccactgaccaccactgcatcatttggaaaatggagagtctccctgccattctctgatagctgtcagtcaggagctgacctcacagacgggcaatttcccctcctattccggtcactggtgacactgggggatgggaggccattccttggcaacacttctgagactgaagtagttttctgaacttgtcctgggcccagaaggaagatactaatcccacctctgctacttggctgctgtgtggccctgggcaagtctcaatcactgggtgtctatatgctcaagtacaaaaaacactaataaagacttatagatgggcacagtgaaaaaaaaaaa

SEQ ID NO: 11917 - DNA, 383 bp, Homo sapiens
ctactttgactccctctgtcttttctctctttgcccccccagaaattgaatcctctccattgactgcacatctgcatttcagtaggcaagctgcaattattcaatgacagcatgccctgatttttaccatggaaaactggggctggttgagatgacccaggcatgacagtcctctgtcagcaaggcaagaaataagtatctgactaaaaatctcacagcaatggagagcaccgctgtttaccattctcatagggctgttcaaaatgttgggaccaagatctgttccatctaggggcccagacatccctgaagattcctttctctattacgtctccatagggtctcatttatgctcttaaaattgtcctcgtgacaagagtggc

SEQ ID NO: 11918 - DNA, 184 bp, Homo sapiens
ttcgcttatacttcttctattctggttatttaatgctagcttagggttcctgtcatttagaccttggacccaatattttactgtagctaattagcaataaattaagtaaaaattatatgaaatcattttaaggggaagaaggacaacaacacaaattagttgtcatcactagcgttttttacct

SEQ ID NO: 11919 - DNA, 284 bp, Homo sapiens
aaaaaaaaaaagtctagctttcttggaaccaacattctagtgaaggttacactttagagcatacaagcaaatccacgataacaaatttacgttaagttccagaaaggaaaggcgtagagtgctattaaaaaggaatagcaggggccatgtaatctagactgagttggggagtaggagatggtcagagcctctctgaaatatgggcatttaaactgaaacgaaagcctgataaagggttagctaagaaaaatcaccccaagtgggaacagcatatgtgaagaccc

SEQ ID NO: 11920 - DNA, 491 bp, Homo sapiens
gagccaccgcgcctggccaacatcaagttttatataaatgcaatagatgcacacacattaatgtatgttgtactgcaacacatttggacccttttcttagtgtgggtctgcagcatttgaacagtccgacactgccctctgctgatatacatgggtaaagtctgcgctgtagatgagggaaaccattggtcttgattttttattccgagtctgttttctctgatgccactgttcctgaattatgaacagtctgagctgtaagcctgtcaccagagctaatgtcacagttcagttgtcatccttttcccagagaacacaagagtgagggtgcttcggacactgggcatctccaaagcctggaatttgatagctcagggctgctgtaagatttgttgttaagtctctttcttcctttagttcttcagcttagcccaagctgtgctcagtttattttagcggacttgtctgagtttcctaagtagactgtactg

SEQ ID NO: 11921 - DNA, 723 bp, Homo sapiens
  misc_feature (32)..(32): n is a, c, g, or t
ggtgggtgcctgttagtctctgccactcaggnaggctgtaggtaggataaccacccgatacccggggaggcggtaggttgcagttgagtagtatatcacacacacggaaaaattatggagtagagtatgaaagctgaataaaacttggaaacaggaaacttcgaagacatgaaggattagagcaggcacgctgggaatcagccctgaagaggcaggcctgcgttaagggctgaatcggtaggaaaactggggcaatgagggacgggtcaggcctaggaggagtacccatatagctgtcgtcagcggacactccttctgtgtccctcagactcagggcagtccctccgcctgcccttcagcaactctccagaacaaaagccgaggtcacctcccctgctcttgaaaaccctcaatggtcaagaagctttgtcaaatcctcatgagccttgcacagtgccaggtgctgtacctaatgtaagtgcctcattttactctaataaaaactaagtattaggctgatctacaggaggaaatgagattcacagagattaaggcaacagtcaaaagacacagaactagtaggcaacagacctggaattcgaccctgtgtcagggtggttccaaatgcaagctctttctactaaactgccagcctcccaggtgcccagaagtgatcctggccctcctcctctaccctgatgtcctgacctcctggtgtgctga

SEQ ID NO: 11922 - DNA, 1050 bp, Homo sapiens
ttgacccaccgaaagtacatgcccccacacactctctccaagcctgcaaatatgtgtgcggatagggacctccaaaactgtaaagcacccatgaaaaaagtctaaggctgtgaagatctgtgttgtgctgcttggcatgcaaggaatggaaacttaccaagtgacttcaagaaaaggggggttttctcctgaggatctggaagctggtattgagccaaaggccctatggggaaaagtattctgttcttgccttcaggcgtttcaactttgccatccctgtttactccactcgtaccttgtccactccgtaatctgcagcccaattccagagggagcaggggagatgggctttgctaaggccaggccaattcttacctagccttgtcccgtcaaacaggcccactggccagttgctggggctcacttgacccagtcggtggccatttgtgtgtccctgagcaggtgctgtggtgaggcagggccagccaggtggcactgagcagctgcaggactgatgtgattgcaggactgtgagaataattattatcactgagccttaaatactgtgttttctgtaaaagtgagtgtccttgaagcattgagcaagctgtgcaaattaccagagattatattttatattgaatttcccagttcctactgtgaaaatttaaaaacaacctctactgaattatcccccaaaatgcatttcctctaagtcctaatactaagtgattatgtaaccatggaaacggttattttgggagaaagaaaatcagagagaattggatctttagcatagctttataaaatcggactttgcttaatggaactttaaactccacagctcacagagtgtaggttcttatgctcagtacgacacatgataagctcctttagggtacatccatctcaataattggtttttgaattctctaaggagagacactatcccagaaaaaaagaaaagagcagcgaaaaaagtcaagtgatttttctgctgcagtcccagatctgttttctgtcatctttcaggagttttcttgaccccat

SEQ ID NO: 11923 - DNA, 547 bp, Homo sapiens
cctttccctttggtttctagttgagtttagcaagaagaatgtccagagactggagggagggagaagagggaggtcagaatatctacccacagtggggtccctcctgattcgctacagccctgaaatggggtcactatccctgtcaggcagcccttccgtgagcgtttctgtccaggttctggtgtctgcttcctcaccttgccccttcagcctttaggtataacagagccaccctacctgtttccccctcaatactagcccagggggctgcactaggccttgtgccctgctcacttcttggcaaatacccctttgtgataatttgagggtgccacctgtctcctgctggtaccctgattgatagagagtgtgtttgcagatttgctgcttcagtgcctttgtaacacagcaaagctgagtggttccagagggactgacctctgatctcaggttttttttgttttttgttttttgttttttttgaggctgagtgttgctctatcgcccaggctggagtacaatggtgcagcctcagcgcactgcaacc

SEQ ID NO: 11924 - DNA, 378 bp, Homo sapiens
gactctctggactatagctacagtggtcaatctgaaagttacatgcatcccctgattttctttttgttagcacccaattccctatatttgatccctttctgcttgaaatacctagaatagtttcttttttctttttctttttctttttttttttttgagacggagtctagcctgggtgacagagtgagactctgtcaaaaaaaaaaaaaaaaaaactcaaggaaaacgaacaaactggaaatcttagacacaaaaaatagccattgaattgtttaagcctcaatattcaggttaaactctagactgagtgtagtcagagaaaaaatgatgaaatgggggatagtatggaaaaatttatccaaaatgaaatacaaagag

SEQ ID NO: 11925 - DNA, 5276 bp, Homo sapiens
cacaactcgcggctctagggaaggccacagacctcagctgtacgagcggaacctggactagaggaactttcctcaggactcagggcacacagcccctcggccactactgtctgcgagcccgaggcgcaggggagcgccagcggctgcaggtacgctgcgcacccgcactggggcctgggcggtgcagcggcggcgggagggtcctgggaaccgcagccgccgaggccagtgtgtgagccggccggccgcggcaagccgcatcccccggccgcccctcgcagccccttgctccccggcagccgccgccgccctcacgcagcccagccgggcgctcgcgccaggacttccccgccgcccgcctcggcccggaacatggctgcgcgccctgctgccaccctcgcctggtcgctactgctcctctcctcagccctgctccgcgaaggctgccgagcgcgcttcgtcgccgagcgggactcggaggacgacggagaggagccggtggttttcccggagtcgcccctgcagagccccacggtgctcgtggcggtcctcgcccgcaacgcggcgcacacgctgccgcacttcctcggctgcctggagcggctggactaccccaagagcaggatggccatctgggcagccactgatcacaatgtggataatacaacagaaatattcagggagtggttgaaaaatgtacagagactctatcactatgtggagtggaggcctatggatgaaccagagtcttaccctgatgaaattggaccaaagcactggccaacctcccggtttgcccatgtgatgaaactacgacaggcagcccttcgaactgcgagggaaaaatggtcagactacattctgttcatagatgttgacaatttcctgactaatccacagaccctcaatctactgattgcagaaaacaaaactattgtggcccccatgctggagtctcggggcctgtattctaatttctggtgcggaatcacccctaagggcttctataagaggaccccagactacgttcagattcgagaatggaagaggacaggctgcttccccgtccccatggtccactccaccttcctaattgacctcaggaaggaggcctcggacaagctgactttctaccccccacaccaggactacacctggacctttgatgacatcattgtctttgccttctccagcaggcaagcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttctggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttcctccccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtgataaactatttgccttctggagctctttgtgaaaaattaaaaaaaaacttagctcaaaaaaaaccacacaaacacccacacaacaccacaacaacacagccccacaaccacctcacaccacccaaaccacacaaaaacacacaacaagagaggg

SEQ ID NO: 11926 - DNA, 5182 bp, Homo sapiens
cacaactcgcggctctagggaaggccacagacctcagctgtacgagcggaacctggactagaggaactttcctcaggactcagggcacacagcccctcggccactactgtctgcgagcccgaggcgcaggggagcgccagcggctgcaggtacgctgcgcacccgcactggggcctgggcggtgcagcggcggcgggagggtcctgggaaccgcagccgccgaggccagtgtgtgagccggccggccgcggcaagccgcatcccccggccgcccctcgcagccccttgctccccggcagccgccgccgccctcacgcagcccagccgggcgctcgcgccaggacttccccgccgcccgcctcggcccggaacatggctgcgcgccctgctgccaccctcgcctggtcgctactgctcctctcctcagccctgctccgcgaaggctgccgagcgcgcttcgtcgccgagcgggactcggaggacgacggagaggagccggtggttttcccggagtcgcccctgcagagccccacggtgctcgtggcggtcctcgcccgcaacgcggcgcacacgctgccgcacttcctcggctgcctggagcggctggactaccccaagagcaggatggccatctgggcagccactgatcacaatgtggataatacaacagaaatattcagggagtggttgaaaaatgtacagagactctatcactatgtggagtggaggcctatggatgaaccagagtcttaccctgatgaaattggaccaaagcactggccaacctcccggtttgcccatgtgatgaaactacgacaggcagcccttcgaactgcgagggaaaaatggtcagactacattctgttcatagatgttgacaatttcctgactaatccacagaccctcaatctactgattgcagaaaacaaaactattgtggcccccatgctggagtctcggggcctgtattctaatttctggtgcggaatcacccctaagggcttctataagaggaccccagactacgttcagattcgagaatggaagaggacaggctgcttccccgtccccatggtccactccaccttcctaattgacctcaggaaggaggcctcggacaagctgactttctaccccccacaccaggactacacctggacctttgatgacatcattgtctttgccttctccagcaggcaagcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttctggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttcctccccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtcatttcccaccgccttcccgggggttcccgaaaaaaaactttttttaacgtggaaaaaaaa

SEQ ID NO: 11927 - DNA, 1050 bp, Homo sapiens
atttttagatattttaaaccttccaacatttacagttataggtgttgtggcactctatggctatcccattccaatggaattgaaaaggagtcaacttccaggtgcgattcacttggcagagaacatgaaagcaatttgtcctttactcttataaacagctgtttttatctagttttcgcttttgtaaagattgggaaatggagtggctctttaaatttggtttgagtcttgcttcccacgtttcttaatcccactgtgtgaaaagcagatatttagaaacgtgaaggaactcgacacctttatgtaacagaacaacacatcactttctttagattgttgggggaaccctagggttctaaggaagtgagtttcctgatgtttgaaatttgccaatgcagcctttcaaaaatatgcttagcatagtttaaaaaaaagaaaattcacccttcttgctgattgtgaggaggtcagatatctgtccctcagctgtcacaatggtagacttgatggagttacatgacagagaagagagcccaaggaagcacctgagtggtttctcatctctgggccactctgttaaggcctgtttgttgactttgggattttcatcttattctggagagttaaggtcgccagatgaataaaatactactgttagtgagcactgggggagctaatcccaaaactgtttagccacaaggttaagaagttaaaaaaaaaaaagagacttttggtgtccttgttttccatttctgtaaatcacattgctgataaatttgcctttgggcatgcaccctgcccattttaggtactaggctcagttactggctacagattgcagattcccttttcagggctgatgcttttaacagtgatagttattcctgataagtaccttaactctgctgtgaggtatcaaaactgctggatctatttttggctgcctctttaccattactccctctagagaatgtccataccataacaacatatttacatatttatcacactgcatttctatcccagctcagaattgtggcaactttcttt

SEQ ID NO: 11928 - DNA, 1145 bp, Homo sapiens
aagacactgcagatgtggtggaaatggcaagagacctacaattagaagtggaccctgcaggtatgactgaattgttgcaatctcatgataaaacttgaagggatgaggagttgcttctcagggtgagcaaagaaagtagtttcttgtgatgggatctactcctgatgaagatgctaacaacactgttgaaatggtcgccaatccggattggcagagaacatgaaagcaatttgtcctttactcttataaacagctgtttttatctagttttcgcttttgtaaagattgggaaatggagtggctctttaaatttggtttgagtcttgcttcccacgtttcttaatcccactgtgtgaaaagcagatatttagaaacgtgaaggaactcgacacctttatgtaacagaacaacacatcactttctttagattgttgggggaaccctagggttctaaggaagtgagtttcctgatgtttgaaatttgccaatgcagcctttcaaaaatatgcttagcatagtttaaaaaaaagaaaattcacccttcttgctgattgtgaggaggtcagatatctgtccctcagctgtcacaatggtagacttgatggagttacatgacagagaagagagcccaaggaagcacctgagtggtttctcatctctgggccactctgttaaggcctgtttgttgactttgggattttcatcttattctggagagttaaggtcgccagatgaataaaatactactgttagtgagcactgggggagctaatcccaaaactgtttagccacaaggttaagaagttaaaaaaaaaaaagagacttttggtgtccttgttttccatttctgtaaatcacattgctgataaatttgcctttgggcatgcaccctgcccattttaggtactaggctcagttactggctacagattgcagattcccttttcagggctgatgcttttaacagtgatagttattcctgataagtaccttaactctgctgtgaggtatcaaaactgctggatctatttttggctgcctctttaccattactccctctagagaatgtccataccataacaacatatttacatatttatcacactgcatttctatcccagctcagaattgtggcaactttcttt

SEQ ID NO: 11929 - DNA, 436 bp, Homo sapiens
atatatgttgaatatcactagtcagggaaatgcaaattaaatctacaataagatgccacttttcacccaccagtttggcataaagtagaagaaggataacattcactgctgatgagaatgtgggaaacaattcttccacagattgctaatggaaataatactgtggaatcctttgggagggtagtctggcagtgcctacttaggataagataagctctgacttggacttatcccttttggaaaccaattgcattgagaaaagtttccaggatgtaaagacatgtatacaaggatgtttattgaagcattgtttgtaatggcaaagaagtatgaacaatttgaacccaacaggaggagaatgactgactaaatagcattgcattgactctatggaacgccacagttattaaaacaaatatgttagtgctgtattgat

SEQ ID NO: 11930 - DNA, 196 bp, Homo sapiens
actatttatgttaactacgcaatcttagacaagtcacttgacttctgtgcattatctgatgatctcttgttatctgatcatgtccttcatgtctacttcctagtaaaagtgttagtctgaagataattgaagatgatgtgtaaaacattttggaaaatactaaattttaaataaactgtagctgttaatttattca

SEQ ID NO: 11931 - DNA, 235 bp, Homo sapiens
tgttggtctataatatagactctgtatcaccagctctggttgtccagactccagccatctctaactctggcaaggctccttgaccccaggctgctcaccaccctgtactgctagttccttctcactgtggctggttggctggttagatagctagtggttggttggtttgcatatggttttttccatctatttttatgccccatttcagactatacctttttgatttactctatcc

SEQ ID NO: 11932 - DNA, 465 bp, Homo sapiens
ttttttttgaagaggctacttggacctctgtccttcagaacccctaaatcggccctatactagactattcattctttgatagattgggagacgacttcttttgacattcctgcaatcatagttttttgtttttgtttttgtttttttttttttttaaatcaggaagggtgagagattctggaatatgatcatgtcaattttggccagttcagttccagggagtgactgtaacagatgcagaaaaataggattgtctcctcctgcccttaattattgaacatgggcattcagtgtgatatactttgctctcatcacagacattacttttctgtcttctcaaggttaggcataatttctacctccagaggataatgattagggagggaactgggttacaactgaagaaggccttaggttattgaacaagtcaggataaatctacttgacctttggcccaacagggtt

SEQ ID NO: 11933 - DNA, 544 bp, Homo sapiens
cataagatttcttgtttaaaaagggtttttttgctttaaaaataatttcaaaatgactgacatgggcaaaaatctaaatgttttattgtattacttaaaacactctgtagccctacctcatatttatgtcctttaaacctgatttccctatgacttttctgtatatccccttaattttagcccaaaccctattcacattcctcaaaatgttggcagactctttacacttccatgactgtatttattctcgcatactcaggagacctggcttccaaccctagatctacctctgatcatgtaaacagatcatcagctttaatgagcctttgttcctgtagctgtagcggaggaatttagctatttcttccctcatacaggaatgatagtcatgcaaacttggagcacttggctgggcgtgggtgctcacgcctgtagtcccaacacattgggaggccgaggcatgtggatcacctgagatcaggagtttgagaccagcctggccaacatggtgaagccccatctctactaaaaatacaaaaaaaaa

SEQ ID NO: 11934 - DNA, 564 bp, Homo sapiens
caggaatggcccagtgcgatctgacacctgggacgctttcagggcaacaccaagggcaatgctccagtctgtatttactctcttctgaggagaaactctggcagcagctggaaaataaaacccaaagcaaggaagaagccgaaaagaagaaatactcaaatacgaggcgcattaatcatcggtgtcagatctagagcagaggacaatggctggtttgaagaaagactgaacctaaattatcttggaaactgatcttctctcctccgggttccctgtgcctgcaagcaggggtcccggtgcagccactggcatggaaccgatgggggcatccactggctgaccagcatgctttgtcacaggacaggttagagatgaccaccttctgtctgtggatcatccatagcttctgcttaggaagctacagaagagaaaaggcctctcacagggacctgcaggacaaattcattgcccatcgtgtcctcaggggacatcatttgcatgccaggatgcagtaaggccactgccttcagatccaaataaagcacccaattagcatgaacttgt

SEQ ID NO: 11935 - DNA, 440 bp, Homo sapiens
atgtacataagcagggggtatgggagtggtttggaaggctgaaccaagagtttcaacttacttcactaataccagctttcaaaactaaggaagagaagtattcagtagaattttcaaacttttcacgtatcagcaatgtgctatctaagttgattttaaactcttcctgaatgtgataaaatgttttctgacacaaaagcctttctacatgctagtgttcagaatcttaaactgggggcatttgatactgaatagaactctctctgctcccatggtaggagtgttggggcacctgagcttcttcccagtgtagtggatggctctttgaactataaccatgtattacataaatgtattatatgttatttttagctactattgagtatcagattgagaatatgcagtaagctaaataaacttttggaaattgatgtatgata

SEQ ID NO: 11936 - DNA, 820 bp, Homo sapiens
acgtcatttttattggctgtgtaatatttcattgtatgatacagatgaaccttagtttatattaagtaaccttttgttcataatccccagatttcaagtaacctctgttggtaaattgacatttatgaagcccttttctctataacaatattataaataatagtttattttctaggttaactcctcaaattctaattcatatttatcacatggtaagatgcaccactagataaatggcaccatgacacttagaacgtaagttctgcttatcgtatcatttttgtgggaaatctctgtaatccagttaggaacctgggcacagtgtcagagaggaaaacagggcacttccccaaaatctggaataaatgggaatatgggtatttctcgctctgcccagggttgtcctgaccagaacagccaagtggaatagatggtgttcactttctggactatgggaggagagttgcgggtgacagggagggcacactggattagcaggatttcctcactgtttgtatctttgacacttgtcagcaattctgcctcagcgaacttcataaagaccaccaggaacttgtttatctggtggcaaagttgggggtagtggaaatgaggatgcaaaagatacagaacacttgaacaacaaacttgatgtaattgatacttatagatcattccacccagccccagcagaatacacatttgttttaagtgcacacagaacatttaccatgttctgaaacataagacaaggaattgatgggcattaaaaaaagcatatacctttcatatataggcattccacttctaggtgtttatc

SEQ ID NO: 11937 - DNA, 353 bp, Homo sapiens
tggagagtgaggaaactacaaggcaccagagggggccagttgaggccgccacctctgcaccaagaaaccagacagctgttctgctgcctcatcagaggtctctgcaggcctttcttgcatcttggcatgggtttgaagacctggcagacttctgactcgcagcagtgagtgatgctatctggggctggaaggaccttggcaatgtctggtctcatggattttggagtcttttttgaaatagcagaacccattcttttttttttttttaacccctgcccccactccccccaacccctgaccagaacccattcttcaaaaggaagcttcttctccttgaagactgggcatttgga

SEQ ID NO: 11938 - DNA, 153 bp, Homo sapiens
tacagccaggagtttgagaccagcctgggccacgaagaccctgtctctaaaaaaaaattttaaaatgagcagggcgtggtagtgtgcacttgcattcttagctactcaggaggctgaggtgcaagggtcacctaagtccaggagttcaagact

SEQ ID NO: 11939 - DNA, 284 bp, Homo sapiens
cgtgcatggggtgagggcctgttgcgggcatctgaatctgcctggggctgctgggttccagcccttgataggcatgttagggcgagctgagggtgaaagcctgctaggcaggatgaggcacacgtgtgtgcaggcacacacaggctctgacttggcatcttcagagactgtgcagtctgggaccctccttttgcctgcattgtgaggacagggctctggggagagaattaaatgacacatgttggcacagggtcttcttttgtctcttccccccaaagaaacaa

SEQ ID NO: 11940 - DNA, 371 bp, Homo sapiens
tagtataaacttctctctgaccactgcttttgctgcatcccataagtttagttatgctgtttttgtttttattcatttctgagtattttctgattttccttgtgatttcttctttgacccattggttatttaagagtgtgttgtttaatctccatatatatgtgaattttttatttttctttctggcgttgattcctagcttcatccattgtcaatgaagataatttcacatgatattagtcttacaaagttcattgagacttattttagaagaatgtgtttttgctattgtttggtgcagagttctatatatgtctgttaggtctagttgatgtataccactgttcaagtcctgtatctctttattgatc

SEQ ID NO: 11941 - DNA, 803 bp, Homo sapiens
aacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccaggccaagtgaaggacctctcatccattcccattcatgtcccatcataatacgggacccaaaaagcaaactcggttttgccatcagttagaaattacgttttgg

SEQ ID NO: 11942 - DNA, 310 bp, Homo sapiens
  misc_feature (8)..(8): n is a, c, g, or t
tcccaagnatgagaaattggctcatttcgtaatcccagcacttgggaggcaaggtgggtggatcatttgagctctggagttcgagaccagccggggccacatggcaggacctcgtctctactaaaaattaaaaaaaaaaaaaaattagctgggcatgagccaccatgcctggcccataatatagtattctgacttgacaacttagctaagtttattaggaatgtctttatttaattaatttggtaaattactaggaatgtagtagtttacattactgctatgaactcccttcttgctacatactcacttc

SEQ ID NO: 11943 - DNA, 348 bp, Homo sapiens
ctcccggctcaagtgattctctcacctcagcctcccaagtagctgggaatacaggcgtgtgctaccatgcccagctcatttttgtattttttgtagagatagggtttcactatgttacccaggctgttctcaaactcctgagctcaaagcgatctgcctgcctcagcctcccaaagtgctgggactataagcatgagccaccatgcctggcccataatatagtattctgacttgacaacttagctaagtttattaggaatgtctttatttaattaatttggtaaattactaggaatgtagtagtttacattactgctatgaactcccttcttgctacatactcacttc

SEQ ID NO: 11944 - DNA, 399 bp, Homo sapiens
tactgcctttatttcagaggtgctctgcccagagaggaggaatctagagaggcagtctggctacagcagctttgacgagctgctgaaatttactcagcatttcaagttgtttgcagttctaacttccaggcagctttgtttacactgtgaggggtaaaccgcctactcaagcctcagtaatgttcgacgcccctccccccaccaagcttgagcatcccaggtctacttcagactgctgtgctggcagcaagaatttcaagccagtggatcttagatttctgggctccatgggggtgggatatgctgagctagaccacccatctccctggcttcagccccctttccaggagagtgaacagttctgtctagctgctattccaggcgccactggggcattaa

SEQ ID NO: 11945 - DNA, 939 bp, Homo sapiens
aggatcccctcggtcttagggagagcatgtggtttgagaatcagaacggcacctgacacagccgagagactggcaggggacacccccaagaccttgagtaccaggctaagaagcatgggctctgtcccaagagtgacagtgaggcaatgaaagcttgccagagactcagccagggttcctagctggccaggtgtcaaggctggggggcaagggcctcaggagcctaagacacagaaggaaaagtctgctctcccatgctggataacaggcggacacacaaggacagagccctcggctgaaagaatgcttccgcactcctagtgctcctctgggccctctgctggctccccttctgttaagcgcctttcactgtgagtgttcctcacagccttgtcctcggctgccctctcctctcaggaccttcttcctggctgaccggagccactgccatggggtcaggtgccatctatgtgctgaaaactcccagatgtactatctccagcctggccctctctcttccatgctccaaacccctatagccatctgcctgtttgacagttctcctggtgtggggcggggtggaagtcatgtgtctctacagcacctcaaaaacttacccagacccaaatttgtgatctttctacacaaatctggtccccctccactgttcacatctcaagattgggccctctgtccctccagctgggcatgtcagaacctagaagtcgtcaatacctccccattctccacatctgaaagtcctttcaaatctgtcccctttaactctgtctccaccatcacctctccaggactacagtagtctactacctgaactttcccaaacctactcgtacctctctaatcctttcttcaattgtcagaaaaatcttagggtgtaaaaaataataaaaattatgtcacttcctggctttaacccct

SEQ ID NO: 11946 - DNA, 724 bp, Homo sapiens
ccgtctcaaaacagagaccgggtttcaccatgttgcccaggcggtctggaactcctaggctcaagcgatctgccacactcggccttccaaagtcctgggatcacaagggggaggcaccacgccaggcagatctattcctttctggttactaaattggaccgggggcgcggtggctcacgcctgcaatcccagcacccagggaggcggaggcgggcgtatcactcgaggtcaggagctcgagatcagcctgaccaacacggagaaaccccgtctgtaccaaaaaaataaaaccaaaattagctggcatggtggctcatgcctgcaatcccagacactcaggaggctgaggcaggagaaccacctaaacccgggaggtggaggccgcggtgagtcgagaccacgccactgcactccagcctgcaaaacgagcgaaactccactcaaaaaaaaaaaaaaaaaaaagacagtgtttcaccacgttgcccaggccggtctggaagtcctaggctcaatcgatcgccgcgctcggccgtccacagtactgggatcacaagcatgagctaccacgccaggccgatctattcctttttggttactaaattggaccggaggcgcggtggctcacgcctgcaatcccagcacccagggaggcggaggcgggtggatcacccgaggtcaggagcttgagatcagcccgaccaacacggagaaaccccgtctgtac

SEQ ID NO: 11947 - DNA, 542 bp, Homo sapiens
agaatcaagtaggaggatatataggagggtaaggactggaagcagccatggaagcctggatactagacatctagagtcatctctcaactggacatctagcatatcttcccctatggctccccaattcacttttatcccatctccaagtcattttttacacagcaacgagagcgagctttttatactcataatttaatcatgtcttttcactcctttaaaccttttgattatgttccactgcccttgggataaaggtcaaagtccttaaaattgcctaaatgacccttcatgtactatgtacttctgccttaccactcacttctcccttccttatcttgagccagccacagctggccttttcccctatttctcagggtcattatacatacgttgcctggctaatacccacttttccttcaggtctcagctgaattgtgatatttttaagaatcctttcttcattggagcttatacgtccccaatagattgttgtcataatacatgtctaccattcatttgtagcattaaatgccagtataatg

SEQ ID NO: 11948 - DNA, 323 bp, Homo sapiens
aaattttgaaaatgtagaatatataattctgtgtaaccgttagaagtcagtgaggtatacagttgtaaagttctgatgccaaacgtgaatatgatgctctcttattcttcacacagcctcctatgagtgagagcatgtcagtcaatctctgaaacagtcctgctactcaacagtgctcaattgcagcttctaatctttagaatgaagacaatattagtgtgaagctgaaaatattagttgtaatataaaacatagaaacgtgttaataacatcttagtcgtagttaataacatcttagttgtaacatattttccagttagaaa

SEQ ID NO: 11949 - DNA, 333 bp, Homo sapiens
ctagaaatatttctcggtttaaaaatagtgttttccctacctcgagtcaaggttcagttctcatctctctaattttagttccttgtttttatgaactttgaaatgttttccttaaccagaaaacagaaaaaagcaatcccagagacaagggaaatttcttgctccatttccctgtagtaaaggcatttctatgtgagattttctttttatcctgagcaggttatcagaaaccaaaattttgaattaggagtttaaagaagaggcaagggggaaaaagtgctctctacgggaccttggttgccatgtggaatgtttttggagcataaaattgat

SEQ ID NO: 11950 - DNA, 471 bp, Homo sapiens
aacagtgtgcggtttcctcatgggcagatttgtgtaatctcaaccatagtcaacaaacagcccatctgcacaggatccttccagctgctcttccataacttcatctctcccctcaacacctgcaaccactaagccattttccccctacccgtctgtaattttgttattttgagaatgccaggtaaatggaatcagagcggataatctttggagcatgattcccttgcattcacctgtgttgtttcgtgtatccatagtttattctttttttaatctgggctcactgcaatctccgcctcctgggttcaagcgattctcctgtctcagcctccccagaagctgggattacaggggcccgccaccatgcccggctaattttttttgtatttttagtagaggtggggtttcaccatgttggccaggctggtcttgaactcttgacctcaggtgatccacccgcgttggcctccc

SEQ ID NO: 11951 - DNA, 364 bp, Homo sapiens
ctttacccttcctttaattctgcccccttccttgttcccatcactccttcccaggaaaacttctccatattattgctgtgcagtggacaaaggatggtcattagcctcaggtgcagagccacatcccaccacttgctggctgggtaactaatacacacctcacagggttgtaatgaaatttaaggacatgttgatgtaatgaaactccaagcatacagaaggtgcttaacaaataatagcttgcatcattatttattctcttcttgtgctgcacctctgtggctctctagtttccacatctcagttgcaggggacgctgatggtatgggggcctagaaattcgatggcagtgatttccacgctg

SEQ ID NO: 11952 - DNA, 776 bp, Homo sapiens
tggtatagctttctctatccttttgcttttaatgtattttcttgtggataacacacgattgggctttgtttgtttttgaaatccattctgacaatctcttttttaattggtgtaatcagattattcacatttaaagtggttattgatacagttggattaatatctacaatgtctgtaactgttttgtatgtgtctcacttgactttcatatctaattttgaatttgtaatttcatattctttgccttaaagagaacgcttgcagatccctcaaaacctggagacaccccccaccttgcacacattataccggtatgtgatggtagaaaagctgcacatcagtcttggcaggcagggcaggagggatgcagggattcacagatgcgactgtgcaacgcacagatgcactgggtctttgcttggtgggttcgaagcctccagacgctgacaaacactgcagccaatgagtgggttcctatggtccgatatggagggcaaggggcgggactccctcctgcctctccctggctgggttcagagcctccgcggagagactgcgttgggcccagagtgggcgtggcttacgtgtccgccggctttcctggcaggcctggcgggggggccaggttgccatgacgaccgcggctaggtcgcggcagactcggttggtgactccgggcgcgtcgaagatcttgtacctgtcgttcgcagtggctcactttcccagtaatccataagaacagcagggataacagggtcccatgtcgtttttttgtc

SEQ ID NO: 11953 - DNA, 1500 bp, Homo sapiens
tggtatagctttctctatccttttgcttttaatgtattttcttgtggataacacacgattgggctttgtttgtttttgaaatccattctgacaatctcttttttaattggtgtaatcagattattcacatttaaagtggttattgatacagttggattaatatctacaatgtctgtaactgttttgtatgtgtctcacttgactttcatatctaattttgaatttgtaatttcatattctttgccttaaagagaacgcttgcagatccctcaaaacctggagacaccccccaccttgcacacattataccggtatgtgatggtagaaaagctgcacatcagtcttggcaggcagggcaggagggatgcagggattcacagatgcgactgtgcaacgcacagatgcactgggtctttgcttggtgggttcgaagcctccagacgctgacaaacactgcagccaatgagtgggttcctatggtccgatatggagggcaaggggcgggactccctcctgcctctccctggctgggttcagagcctccgcggagagactgcgttgggcccagagtgggcgtggcttacgtgtccgccggctttcctggcaggcctggcgggggggccaggttgccatgacgaccgcggctaggtcgcggcagactcggttggtgactccgggcgcgtcgaagatcttgtacctgtcgttcgcagtggctcactttcccaagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaggaggagaactggtggctgtggttagaggagcaaatgccccactgctgcagaaaaccatcctagaccagctggaggccgaaaagaaagtgctggctgaaggcagagaacggaaagtgattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggtcagctcatctacttccacaagttcaacacactgtcgtttctcttcctccaacattatgcttatagattgatatcagtttgtgacagaagaaattatgaagaaccaaaataggaacagcaagtgggtcatgaat

SEQ ID NO: 11954 - DNA, 1201 bp, Homo sapiens
tggtatagctttctctatccttttgcttttaatgtattttcttgtggataacacacgattgggctttgtttgtttttgaaatccattctgacaatctcttttttaattggtgtaatcagattattcacatttaaagtggttattgatacagttggattaatatctacaatgtctgtaactgttttgtatgtgtctcacttgactttcatatctaattttgaatttgtaatttcatattctttgccttaaagagaacgcttgcagatccctcaaaacctggagacaccccccaccttgcacacattataccggtatgtgatggtagaaaagctgcacatcagtcttggcaggcagggcaggagggatgcagggattcacagatgcgactgtgcaacgcacagatgcactgggtctttgcttggtgggttcgaagcctccagacgctgacaaacactgcagccaatgagtgggttcctatggtccgatatggagggcaaggggcgggactccctcctgcctctccctggctgggttcagagcctccgcggagagactgcgttgggcccagagtgggcgtggcttacgtgtccgccggctttcctggcaggcctggcgggggggccaggttgccatgacgaccgcggctaggtcgcggcagactcggttggtgactccgggcgcgtcgaagatcttgtacctgtcgttcgcagtggctcactttcccaagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagtaagattctctctcagccaacagtcatacaacattgtaaaaagaatttaaaaatttaaaagagtcaggaaggagaagtgtgagagtgacctttctcaggtcattaaaaaggaatcagtgtggactttttgttgatactgtcatgatactttctaatttctctagttatgaaggttcctattccccaccccacctccctgtgtccctcttggcttgagcagttcttggtgctgtatgaagagaagaaatatatgtcactcaaatgcatattctccct

SEQ ID NO: 11955 - DNA, 383 bp, Homo sapiens
ggaactctgagagcccaagcctgtgcctggcacttggtgcaatggagccttgtgtagaggttgcattgttttttgtggatggcctctcaggagcctcaaacatcagcatctgacagcaccattttttggcttagtttcatcagagaggacctgtaccttggccatcattaaaccagatgcagtggcccatggaaagactgatgagattatcatgaaggtaagagagacaacacttaccatgcaccactgtccttgtgtcctcttttgtggataaacagggatggggcactgggcagtgatatcttagtgcagaaagatgaattctaaggggttgtagctcaagttccattcaagtaaatgaaaatgttaaatctgattgggac

SEQ ID NO: 11956 - DNA, 1631 bp, Homo sapiens
aagaaaggaattactgaatcatacgataactttatgcttagacttttgagaaactgccagactgctctccaaaatgactgtgccattttacattcccaaaagtaatgtatgaagtttctaatttttccacaccctcaccaacacttattatctgtgtttttgattcttgccatcctagtgtgtgtgaagtagtttctcactgtgatttgtatttgaatcttcttgaaggctaatgattttgagcatcttttcatgtgcttatcgtctcttctttatatagatgtctattcaggtccttggcccatttttaatttgggctatttgtcttttcattactgagttttaagaataatttttatttattctagacacacatcccatattagataggtgatttgcaactatttcctcccattctgtaggtttcttgctggtgtccttttaggaatagaagttttacgttttgatgaagtcaagtgtgtatgttttcttttgttgcttgtgtgtttgatctcatatcaaaaaaccattgcacaatccaaggccacaaagagttatgtctatgttttctagatttttatcattttagtgcttacatttaggtctttgatcttttggtgttaattttttatattgggtgtgaggtaaaaatccaacttcattcttttgcatgtgatatccaattatccagaaccacttgttgagaaggctagttcttcctcactggattatcttggcacccttgtcaaaaataagttgactgtagatgtgaaggtgtatgagttgctaaaaatacctcttctgtgatatttataatttattttctaaaaggataagttataggtcacatctcagattacaatgattcaagtcaaaaagttcaaagtagaatttactttcaaaattgtttgttcccccagagctagttaatgcccccagagctagttaataaactctatttgcagataaaagcatgctttcccttcaaaggtatttcaccaagacgggaaacacaaaactaaataagctgggaaactgaggatacacagagggtctccttaatctctggatatgtggtctaatgtatcctttttgtgctcattttttcccttttatccagaaatacaacattacctttttataaaattcctggagattgatcatatctctagtgtttgggtctagaatgtattttttggccaaaacatctctttaccccacttccacatgtggaaagaaagaaaacatggtactctaatctcacaagtgaggcatggggttgtttcctgaaatgaggcaaggactttggacaagaacatgtttggacttgagatggtttttgtaaacccaaatgatattagttctagtctgtctttatcgctcactgtattttgttttcattcatactaatgaataatagacttgattgtgttccatcatttatgtcattaatatttcctttatgtttgagtgctgtgcagttctccttgaaacttgtatggagattgaacttgatagtgatttaaagtaattaattcatatgtcagttgttagcaaggtctagtaattaaaatctactttagagtaagttattaactctccaaaataaaaacactttatcaacttaccag

SEQ ID NO: 11957 - DNA, 633 bp, Homo sapiens
tgaccatcacttgcaactggataatctttgagataccttccttgagtggcagataagtatattgatcaccagaagttagtctttgtactgttccttccaggtaaggacttggctgtttgctgatttttgttttttaattaacccatttctggaagatgctgcagaagtttgtcctggagagctacagtatttttcaaagctttatctgccttgatgagaaatggtcagaggcttaatggtttcattgcctaacaggattcagtggagtaggattccaggacacagtggccttgtatcatggctggccctccaggagaaagcatcttctaaaggtttaggaagctgtcaagtttagataaggctgagctccgatcctctgggaccttggttgtattaataaggagaaattaatttttaaccactgggaacattgccaaattatgtgacctttggcagaccagctgtgctataaaaataaatcccccatttctgaaaatgctactcctatccagtagaacaataacaatgtggcatttaggatagagaagagtaggattgagaagaaaggagagaaatagtttatgctgtcttctattgacttgggttaatcgtgtgtcccggtgctggcacgcc

SEQ ID NO: 11958 - DNA, 610 bp, Homo sapiens
tgaccatcacttgcaactggataatctttgagataccttccttgagtggcagataagtatattgatcaccagaagttagtctttgtactgttccttccaggtaaggacttggctgtttgctgatttttgttttttaattaacccatttctggaagatgctgcagaagtttgtcctggagagctacagtatttttcaaagctttatctgccttgatgagaaatggtcagaggcttaatggtttcattgcctaacaggattcagtggagtaggattccaggacacagtggccttgtatcatggctggccctccaggagaaagcatcttctaaaggtttaggaagctgtcaagtttagataaggctgagctccgatcctctgggaccttggttgtattaataaggagaaattaatttttaaccactgggaacattgccaaattatgtgacctttggcagaccagctgtgctataaaaataaatcccccatttctgaaaatgctactcctatccagtagaacaataacaatgtggcatttaggatagagaagagtaggattgagaagaaaggagagaaataggagttggcaaaaaacaaaaaaacaaaacaaaa

SEQ ID NO: 11959 - DNA, 606 bp, Homo sapiens
gaaattagaagacactaatttgatacacttacccttttttcaaaaacattatgtaattaccaaaaacatgtaaaaatcagttgtgtagattcaatctattttaattacttggttgggtttttttttttttttgaaatcacagtttatcagagttgatactcagttttttaaattatattgtataaccctctgacttctctatttacctttatcccctatcaacataaaaaataggccaggcgcggtggctcacgcctataatcccagcactgtgggaggccaaggcaggtggatcacctgaggttaggaggctgaggcaggatagttgcttgaacccaggaggcggaggttgcagtgagcagcaatgccttgcactccagcctgggcaacaagagtgaaactccatctcaaataaataaataaataaataaataaataaagttccttttgaaaaaaggaggatagaaaaaactataagctgggcatgatagatttaagttctcagacctaatcccagctctttgggaggctgaggcaagaggactgcttgagcccaggagttcaaggccagcctgggcaataaaaggagaccccgtctctacaaaa

SEQ ID NO: 11960 - DNA, 190 bp, Homo sapiens
tggcactgccgcctagcccctagcacagcccttcaccaggcctgcacgacccagacggctggagtaggaaggggaaaaccccggcctggacggctccgggcccctccggaccaggatctgtccggcggggctgagaagaaaacccggagcagtgatcagcctcgcgacccaagggggtcagggacgatag

SEQ ID NO: 11961 - DNA, 1898 bp, Homo sapiens
  misc_feature (985)..(985): n is a, c, g, or t
  misc_feature (1268)..(1268): n is a, c, g, or t
gctcaaatatattatgctctctcttgactctgtgcctttgcaagtgacattcacttggcctgaacactgttccagctccctctgttctttccaggtgatgccttctcgccttccaaatctcagtttagacgtgctcttctctgggaagtttattcatttactgtgtgttagatgttgttctaggccctggggatgtagcagagaagaagacaaagtcactgcatttggtgaggagctgtcatcttcagaatcaaaacttccccctagtgcagtgtccacctccagatactgcttcatttctctgctctctttgttcatgaaactttttcaataattgctttttcatttcttcatctccagtttttatctaattccaatttagtttctctctccatgactctgctcacactgatttttctcagacaccaacttttttttgccgcctaatacaatcgccatgttttttcttcatgttatttgatccttttagtggcactgggcataaatgaccacacgtttcttttcgaaacattatcatgacttttctgatgccacattctcctggcttttcttttgccccacaggaattcctgtagacatccactgccttactagatgtagggagcacctcagggcccagccctgtgcccactcctctctttagccctcatacttttcctaagtggtaccatctggtcccttgcttgaaatgccaaatgtgcattaaatgccaaaatgtatatcttcagcccaacctctgctttaaccccagcaactgtatgtccagatcctttttctcccttaatggataaggataaagaatcatatgaggatgcttaaacaaagtaggagccaatgcaacatgtctttaaatggagggaacagatttcaggttcctaaggacagcattgatgattctacccaagtgtactgaagatttctagcaggcgtgagatgctttcctttaccattccaaagtgttgtngctgggactttgctaacttgcctctaattttttttttaaatgaatatatcccttgttcattagctacctattgaacataaataacataaatgagatatcatgtcacaccagttagaatggcgatcattaaaaagtcaggaaacaacaagtgctggagaggatgtggagaaataggaacacttttacactgttgatgggactgtaaactagttcaaccattgtggaagacagtgtggtgattcctcagggatctataactagaaataccacttgacccagccancccattactgggtatatacccaaaggaatataaatcatgcttctataaagacacatgcacacatatgtttattgcggcactactcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacagaaaaccaaacattgcatgttatcactcataggtgggacttgaacaatgagaacacttggacacagaagggggaatatcacacaccggggcctgttgtggggttgggggagtggggagggttagcattaggagatatacctaatgtaaatgacgagttaatgggtgcagcacaccaacatggcacatgtatacatatataacaaacctacacgttgtgcacatgtaccctagaacttaaagtataataaaaatatatataaataaatgtaaagagactaatgtaaaaaataaataaattttaagaagagaattagctacaaataagaaaactaaagttccttagaacttaaaaaataaatcttcat

SEQ ID NO: 11962 - DNA, 177 bp, Homo sapiens
cctccccagtcttcagagtgatttaatgtgctcaggtatttgaaatccttaatgaattacctgacaacttgtttggtttgaatgactggcataaccaaatgaatcagtcattggcctgctatagatctggcgtattaaagaacaacaattgattgggtaatcatccataattaaatg

SEQ ID NO: 11963 - DNA, 1167 bp, Homo sapiens
tgaagtatgatgtggagcatcttttcatgggcttatttgccacctgtatatcttctctggtgagatgtctttcaggttttttgcccattatttaattgggttactcattttcttattgttgaattttaagagttgtttgtatatttcagttgtgttctttatcaaatgtgtcttttgcaagtattttctctcagtcagtggcctgtcttctcattttgttttaagctattcttttttaacaccccaagattttcatcgttacttttaaggccactgtgcacacataaaatactaagaagctaaacttaatatctacaggtagaagttttaaattcaagattttaaccaaataacagagttaatgctaaaatctcacttttgaagtttatgttgaatattagcattctaatatttaatatttttctatttttgaaataggaaatggaaaagatgcagtaggtttttcaaaagggtatcataggtgagcacttcttatagaagaagaaaactaagaggtagtgctatttacctcttcagcactaagtttatctttatttttatttatttctataaagagatgggagtctcactgtgttgcttaggctggtcttgaactcctggcctccagtgatgctcctgccttggcctccgagagtgctgggattataggcatgaggcaccacacccagccagtaatctttagcttctagaaacaatcagatttccttaagattttgcaattaggtttagaggagctcacttgctttttcaaatatgggttggatatgtccaaaaaaagagttttgcctctacaatgaaaaatgatttttaccagattatggaaaggaagattcataaaaatgtgcctttaaaaagcttttttaaagtgcaagttcaccaatttgacttttgaaaatacgttcattttaggaattgattttttaaggaaagttgtaaacacagcaaagcacagaattacactggttcagacttgcatcttagcaccaaaatccactatacaaatgcagacagcataaagtaacctagtttcgctttaaatttgttgcttattttattctcccttataaatgtcattggtcttttgttagaacataatttactactttattttgaaataaagtctaagatttagcatgtaagtggtat

SEQ ID NO: 11964 - DNA, 200 bp, Homo sapiens
ccgatggaattctcatgagatctggttgtttaaaagtgtgtagacttctcccttcttctctttctcctgctgccatgtgaagaaggtccttgcttccccttcgccttctgccatgattataagcttcctgaggcctcccagtcatgcttcctgttaagcccgcagaactgtgagtcaattaaacttcttctcttcatgaa

SEQ ID NO: 11965 - DNA, 554 bp, Homo sapiens
  misc_feature (547)..(551): n is a, c, g, or t
  misc_feature (554)..(554): n is a, c, g, or t
tgtaaagatcaaatcagtataattgggatacttattgccttaaacaggtatcttttctttttctggaggcagccaaatgattcttatctgggtatttgaaaatatcaactagatttttgtgaactatagtcactctactagattgatcaaagcctaggtctcatttcttctgtctgtttgtacccattgatcaacttctctccatcctcttctttgctttgctgaattattgtttccacactggaattcctcagcatgcttcctgaatgccttctgctgtagcgaatctcctgcagggtccacacgttagtggctctgtacgctacttttactttaggtttctgattgtttatgttgtaaaggaaatatttccatttatgattttaaaaatattgtttgtgaaagaacaattcttttcacagtttttaatgaaaggtttatgcctataagtaatgtctatggaggaagagacctcagggaattgacttcaggaaatcatgaatttgctctttattatgttgtgtaataaaacacttttatattcaannnnnaan

SEQ ID NO: 11966 - DNA, 408 bp, Homo sapiens
aaggctcaggtgagagctttctgcttgtgcacttgaaaattgaggcctcatcaacaaatcctctttatgaaacttgcgtgattagtctttccatcgttgcagctgtttccatcaatgcagtgtccctttaagaacctgcaggattactaatggatacaggtcatggtgacagacttaagtaaaccttcagcaataaacaatcatgttgagttttcatatgattaccatcatctcatgcctatcccaatagggcgaagaatgcatgaaggaaatgaacatgatggatcatatacatcatactgtcatcccccaagagtgagacaaacagtatcttgaggaggctcacactgtcttcctgataaaagccaacaagaatgtgcattaaaatggatcctgtattttatgata

SEQ ID NO: 11967 - DNA, 379 bp, Homo sapiens
caataaatgcctcttccttcccaggacaccatcacttccagtaactttttcatgttttttggagtaaaaaccttggaaccattttgaaatcctttctcctttctctactaaatctgatcaaatacccagctggtcttttccttcatctctatctgatcattttgatcctcctttggcatgtttgctgataccaccaagctctgcagctggtcccccttatccctcatctgtggattactagcataagtcaccttctggacttggtgtctccagggtagggtgtctgagacaatctatggggtaggggaagcaaatatagaatttctgttatatatatcttcaactaaaaattagaaatccaatgttactaaattttggt

SEQ ID NO: 11968 - DNA, 370 bp, Homo sapiens
tctgggcaaaatgtaaaatgtggaccttgtggagaaaaatctgggcagctctattcaaccgatatattcacttgccgatatatattagtaccacagcacttctttctttcttctcatgtttatcatatatatctttattagcaaagttttaaagtatttttaaaacataaaaatagaagtagacactcatacataatttcagcacctaatattcactgttagtattttggtgtgcttattaactagtgttttttcctttgcataggactttaaatttattatttctatatattaaataataacatacatatactttcatattctgcctttttcacctggcattatgtcacccccatggcgttctaagacc

SEQ ID NO: 11969 - DNA, 519 bp, Homo sapiens
tttttttgagacagagtcttgctctgttgccgaggctggaatgcaatggcatgatcatggctcaccaactataacctctgcctcctaggctcaaacgatcctcctgcctcagcctcctgagtagctggggttacaggcacatgcctggctaatatttttattttttgtagagatggggtctcactatgttgcccagggtggtttcaaactcctggcctcaagcaatcttcccgccttggcttcccaaagcactgggattacagatgtgagcctgaatggcccttcattcctttttatggctaaataatctcctttgaatccaatctgctctgaaaaggggcagtagcggtggctgcccagcctgtcttgggcgctcactccaacgctgaatggtatactgtgtggcatcctccttgggtctggggaagccacagcaggcactgccctgagcccagagggatcatatgatacaaagacccttgctgctcctgacagttgggcacaagctgctcctcatca

SEQ ID NO: 11970 - DNA, 391 bp, Homo sapiens
gtttaaatttatgccacatttgatattaacatattttgttgggtgggagcagttgctcatgcctgtaatcctagcactttgggaggccgaggcgggtggatcacttgaggtcaggagttcaagaccagccaggccaacatggcgaaaccccatcttctctactaaaaatgcaaaaaaattagccaggcatggtggcacgtgcctgtaatcccagctactcaggaggctgaggcaggagaatcactagaacacaaggggcagaggtcacagtgagccgagatcactccactgcactccagcctggttcacagagtgagactccatctcaaaaaaacacacaaaaatatttgtttatttatgtcaaattgtactttgaaaataattcatttct

SEQ ID NO: 11971 - DNA, 584 bp, Homo sapiens
cagtccccagatacagaagcctaacagtctcacatttagacctgccacagtgaaactgcagaactgtaagaaggacagagtgatataaacgactaccaatttcccagcagcagcactggagttgagcagtgagtagaccaaggtcttcattatgctgagagaaaatagctgtcaagttgcttgaattgtgcccacagcataacattaaagaagagaacacaattaagtcatttagataaaaatatgccattcttatctgtttggttttttaatcttggcttaatatttggggttgagtcatttgttttgagagctgtcctgtttattgcagggtgttcagcaacatcccagatggaagcagcatccccctacccagctgtgacaaaaagaaaaaaaaatgtctccagacactgccaaatatcttctgggggtgcccctggttgagaaccactgctttagtggataaactttaggcaggagggaaatgatcgcagttggatagttggaggaatgtggagcaagggaagcaataaactgtgaccataaaaacatagaaagatgaaaaaaaaacaacaacaaaacaa

SEQ ID NO: 11972 - DNA, 337 bp, Homo sapiens
tatttctccttctattcatcttttgtacttggagtggtccgcaaggtgaggagagttgagctcaatgaaaagaaggtagatttttgccttttttatgcagaacaatgtcttcaaaaaaatcagaacagaaaaaataagatgcattctaatggatctttgacactttttggtaatgaagcttttagttcccatagagttgtgtgtaggtcagaaaatctgccaagtttcttactctatgttcagctcaagtttgctctggcaccaaagaggagagaaacggggggttgcagaaaacagggggttgagagctttatctttttgtcctttactttcatct

SEQ ID NO: 11973 - DNA, 512 bp, Homo sapiens
acatatattttggaattcattctttaatgctaagaacttaaaatacactactctctatgaacactccctggtagtactagtaattctttctatattcttgtatttgtgagtcattaaatctgtacaaaacataatttacaactaaaaaccaaaaatgtctagacacaaaatatttggtcaatacaactctaaaatacatacattcactattattttataaagaaattggatggcctagcatatgatctatatggagttaaggaaccaaatgggtgattctaagatacaaagaatgaaagataaattaattatgtttttaatcttctatcagtgtaatacattgccttaattgtaaagcagcagaatgaatcaatgtaggtgcattcaatttttcttttggaaatggaaattacattttatcattgtcatcctaagagtaatacaagattttgagaaaagttttggtaaaaacagaaaaatgttagaaaaaatttaaaaagtaaaaaaaaaaa

SEQ ID NO: 11974 - DNA, 453 bp, Homo sapiens
tcagttttctcatctataaaatggagcaagcaagagtcatgacactcagatgctgcgcagactccaggtgatcctgcggtatactcgatatgcctggcatatcatcaggggtcccacacatgcacaagtttccctttcattccaaacagggaatgttctttccagttttaagttaatgctatttcctcatctgcattttttttctcttccattcttaataagttgagtaagagggacagtgaactggaaagggaaaacgtgaaaatgccgagaattctgaaaatacatctttccaaattgtgcagcttggtgttggcaagatgacaagggccccggaaaccgggtgcaaacacagcacagcaaaatcacgcagcttgcgtgtgcaatatatgtatgttacatgccaactgctgaacaagtgcttttaaacaaatgacaaatatgatacgatgc

SEQ ID NO: 11975 - DNA, 327 bp, Homo sapiens
  misc_feature (10)..(10): n is a, c, g, or t
  misc_feature (12)..(12): n is a, c, g, or t
cctcgtcacnanatgtttctcctgtctcccttctcctcatttcaatttggcaacttactgttgatccccagtattattttctaaattgaacttgtttgtggaaataaaaaatctgaggaccactcagagggcataagggaaccctctttgtcttagttcataaggactttctcatcatttttgtgtgtagtattattacatttaaaataaggatgatattgctgaagtagattaaatgttctctatagatatcaaagaagattagtaattctaatccttaaatttttagtctgaagtgaaatcttactataatcaaattgttgccca

SEQ ID NO: 11976 - DNA, 795 bp, Homo sapiens
agtacatgtctgtaattccagctactcggaaggctgaggcatgagaatcatttgaatgcagaagagggaggttgcagtgagctgagattgtgccactgtactccagcctgggcgacagagcaagactctctgtctcaaaaaaacaaaagaagagcgagcctcagaccggggatatggtgactcacgcttgtaatcccagcacctgtgggaggctgaggtgggaggatagcttgatcgcaggagttcaaggctagcctgagcaacatagtgagaccccatatctataaaaagaatttaaaaattaatgagctatggtggcatacacctctggtcccggctattcaggatgttgaggtgggaggatcgcttgagcctgggaggttgaaggcacagtcaactgtgatcataccactgtacttcagcctgggtgaatacctgcatatatttccaccctcctgccaaaaattacctactaaaagaactgttaagagaataaaaagagatcaagcacggtggctcacgcctgtaatcccagcactttgggaggctgaggcggatggattgcttgagctcaggagttcaaaaccagcctgggcaacatggcagaccctatctctactaaaaatacaaaaattaaaattagccaggcatggtggtgcgtgcctgtggtcccagctactcaggaggctgaggtgggaggattgtttgagcctgcagggcagaggttgtagtgagccaagatcatgccactgcactccagcccgggtgacagagtgagactgtgtctcaaaacga

SEQ ID NO: 11977 - DNA, 275 bp, Homo sapiens
tcctgagttggggaagatgggaggaatgggatgttttggaaggctggggtagagagccagcagtttcattttggacatgttagggtttgatgagtctattaatcatccacatgggaacatcaactaagcagatgcatatttgaggctgaagctcagcagagtatctgggcaggagctggaagttgttagttgtcaggaagagaatgaatttggccaggcacagtggcttatgcctataatcccaacactttaggaggccaaagcaggaggacggc

SEQ ID NO: 11978 - DNA, 522 bp, Homo sapiens
atattttagtagtcactctatcaaataatttggttcactcccctcctctaaacctaaatttttttaaaagaagagaatgtatatgtgtgtaggtattctatttatcattcatagtaacttctgaggtgttaaattgcataacattttttgaaacaaatttgatcaatcattattaattgagataagtaatacaaaggccttgtctttaatttaaataaatcatttccatatttcaccccagtggtaaagagaccacctaattgacaactactgatttataggttaaatagaatctgtcagtccttttcccaagatttgacagtgacattattactcaagtttgtaattagctggctctctttttctcattagtttctgtatttttttctaagccctcgaccccaaggatcagtgctctcagtcaagacctgtcccgagcttcccaccaagtcactgcatgcttttctgactcttgtcaataactgctgaatttgactttctaaaacccccattttattctag

SEQ ID NO: 11979 - DNA, 476 bp, Homo sapiens
caggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataata

SEQ ID NO: 11980 - DNA, 612 bp, Homo sapiens
cagctgcagctttctttctgttttgctttcgaggtagggtcttactctgtcccccaggctggagtgcagtggtgtgatcatagctcaatacagtctcgaagtcccaggctcaagcaattctcctgcatcagtctcccgagtagcatagtgtgccactatacccagctaattttttgtagagatggggtctctctatgctgcccaggctggcactggcaactttcttctttttagaataattaccgtacttaggatccaatattcttcccatctcacttgttttagaatgtgtgtcctcaggtttggattttaatcatgtcccgagggatcttgccttctaaataaaggaacactcactgggtaccaatgttcttttctgtctcctctggtgaatcagacacttctcttcttaatagagttcattgataaagggcttgggaaaaggaggtcccttcattattgagaatctaaagcattggattgggagcccacagaagaactggaacagaggctgaggcaggaggatcacttgagcccaggagttcgaggttgtaatgaactgtaatcgcaccactacactccagcctgggtgacggagtgagaccccatctc

SEQ ID NO: 11981 - DNA, 439 bp, Homo sapiens
gtactaaaccttgttctttcaacctaagaatcacttaagacaggggtccaatttagataaatataccaccctaaaggtcagtgaccaaatttggtcaacaagggtgccatcacagccgtcatcattcttgtcaccgtcaggaacaactgtcaccttgccattaccaggaagggaaagcaactggaatattccttttgtaagttctatttacagactacaaagagtccaacatcatcttagtatgatcttacaacacgataacaatggaagaacccaaaacattaaaggcttcccagaaaagaactttttgatattaaaagctgataaaccacaagaatttctaagaccatgccacactctgggacaactcctaaccacactgtaaatgtcaggcatctattttctgaataccaatggcttcaagtgttttgttttgtaa

SEQ ID NO: 11982 - DNA, 374 bp, Homo sapiens
ctcaataaaaaccctgactctttggggagatgttctaacacaaagcacagaaaatgaaaagaagattcaacagcttcatttttcaatttacctaatctggataataatctctacctggtgataattcatctcagggaagaatttaccactattttggatcagattgtacttcatagtaggtaatcatttcaaggcagtactcagtataggtgtttaatccaaaggtaatgttagttatttttctgcagctgcaaacatattttccaaggaaacaatattacaaaaggcattttcagagaggaccaagatggcagaatagaaggctccaccaattgtcaccctcgcaaggacatcaatttaattactatctacag

SEQ ID NO: 11983 - DNA, 195 bp, Homo sapiens
cttgaaaatatcccacatgatctttgcataaaaaagaattaaaattttaattgtgttaagctactctgagtatttgttacagcagcagagcacatagcctatccttagacaaataggtaagtaaaacttttaacgtggtttgcctggcatgaagtaaggtaatgagagctcagactagtgtaggggcagcggagc

SEQ ID NO: 11984 - DNA, 311 bp, Homo sapiens
  misc_feature (300)..(300): n is a, c, g, or t
  misc_feature (305)..(306): n is a, c, g, or t
  misc_feature (309)..(309): n is a, c, g, or t
ggaaaaatgggaaggaaaaaatgtctgtgcatgttcagtacagatgcaaccatccgtttttctttttttgaatatttctcacccacggttggttgaattcacatacagtatctaaatttcattaaatataaatatggaaaatcccatttgctgcatgaatttgtgtatttgaatgtgttttagtgtatttggtgttttgttttgttttgtttttgagactgagtctcgctctgttgccaggctgaagtgcagtgagccgagattgcaccattgcactctagcctgggcgacagagcaagnctcannccnaa

SEQ ID NO: 11985 - DNA, 252 bp, Homo sapiens
tgtctggcctgttgctacgtacaagtacacagcttcttaatacgattaggaaattacatcctatgttggataggtgaacaaattagttaagtcagatcaacttaatagttacagaatatgttggttggacgtggcggtagggtatagtgaagggtactaatgtatgatactggctgcccagtagaattagctggaagccttaaaaaattttatcaccccctcaggatctgggagaatttactaaaaaagaac

SEQ ID NO: 11986 - DNA, 397 bp, Homo sapiens
aattttacaggaattgcccctccctctctgtttgggtgatccttctcttttggtggattttttcatttcaaaatcaggtctcttgccagcttttaactaccattgactcatagtttttaccttcacaaagctgtttgctaccactatcaatcactcagagtttaagaactttctatttccactcctgattattgtctgtgggcctcttatgactgcctgtatctctctagaatcttccagaagcaacatgactcttttagggcctttgctgccagctaagaaggtgaagaaaagtcaccactgcaataaaaagagggcactttgtcttacttgggcaataaaccaccaccaggcaggcagcagccaataggcaggcacccccacccccaccaaaccc

SEQ ID NO: 11987 - DNA, 1417 bp, Homo sapiens
tagaacagagaaccattaaccctagcttttaggaacatttagatgacttacattttggaggggaaatgtctatgtacctttaaagtgtctctacatcaggaacacacaaagaaaacaattccagcaaccctaaaattaggctcaaatgaaatcaataaatattgtctggctgatcattataaattttatcttttaaaagcctgacctgctcttttttctcaggcttctattttctcaatgctacggttctaactatctaggtgaatgttacaggctcaatctttggaaagtcacttaggtctaatgaggggaaataaggcccagagagggtgccccacatgcttttggtctcctgcctttttgcatattgcattgaccacagcaacaccaacaagaaaccaagtacactctgaatcttctcgacattttgctatcagagcaatttatgttcatggaaagtcacaattataaatttgttccttttaaaaggaactcaaatggaatttctaatattagcctgtgagaatgtcctgactgattactgaagaatggacaaacttctaggatagaattatgggtgttgctcagatgggtagcagagaaactggggaagctcttgtactggccattgaaatgttaacactgaaaccctgcagcagtggggagagtgtgcatgctttctgctgctggtaggtggtaaggctgtatgatgttttaaagcacaggctcaaaaatcacaattcactatctacatgaccttaagcaagttattttacctctctctataactcagtttcctcaactataaagtgggataaaagcgtatctcataagataattaagaatattataatacataataaagaactcaggacagtggctagtacagaggtctcagtaaattttagtttccatttcaagtggctgttttacttgcctattgttaacagactcagaaattctgagagtctggttagaaaaaggaaaattcgttttttttcagtctaccttgcaagataagggaaaccaagtgacagtgctgaaatgaacactgggctgagtggtaccaaacatcagtttagtcactaattagccatgtgatcctgttaagaaggttagcttgtataaccttatttttaaggacacataatgatttcaaaagtccaagtataaatcagtaattacaaatcagccttataatacccaggtatctatgaaaactaaaaattgagagttgataaatataagaaattactgctgatctaaaaggaagtggcagaaatcccctgaaatgtgttaaatctttgccttactaaatacttgccagaagctataactatattttcttattaatttcatgttcatcttctcaacaagtaaacaaaaataaagccaacaaaattctcataaaaaaaaa

SEQ ID NO: 11988 - DNA, 575 bp, Homo sapiens
ataatggtctttttctaagggaggcaatagcaagtgatagtatgtaaatggttttggttttcatcaacattttttttgaactaagcagttaaggaacagtggtcacataaatacacctaccattctgtacagacatggtttctgcttttacaagtgttatatggtattttcaaaaaggcaaaatcacttaagtcgggaaattaatgaggaaatcattaagatattatgactgcctcaaagaacatttgaaaagttaggcatacacaagcagtttgtcaaataaatgtttctggattagaaggaaaatttgttaatgcccaagtcagccatcattctttgtagatatctattccaccagacagaaattatttgcatctcaattagttggaaatctgcaagttaacaggcaattcagtaagtctgagactttaatcaaaggtaaactgtgtggtgcattgagtacttttgcttggagtgccttttgcctccccatataatattaaaaagatgtacccagttgttttttatatttctaaagttttggaaatattttctgatataagcaggaaaagaaa

SEQ ID NO: 11989 - DNA, 815 bp, Homo sapiens
aggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacac

SEQ ID NO: 11990 - DNA, 6721 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccatcgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcacgtagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcagtgtaccaagatctccaaggggagaggctccctacccccacagcacgggctggaactcctgactgtgtatgcctgggagcagggcgggaaggactcccagttcaacatggctgagggcttccgcacggtcctggagctggtcacccagtaccgccagctctgtatctactggaccatcaactacaacgccaaggacaagactgttggagacttcctgaaacagcagcttcagaagcccaggcctatcatcctggatccggctgacccgacaggcaacctgggccacaatgcccgctgggacctgctggccaaggaagctgcagcctgcacatctgccctgtgctgcatgggacggaatggcatccccatccagccatggccagtgaaggctgctgtgtgaagttgagaaaatcagcggtcctactggatgaagagaagatggacaccagccctcagcatgaggaaattcagggtcccctaccagatgagagagattgtgtacatgtgtgtgtgagcacatgtgtgcatgtgtgtgcacacgtgtgcatgtgtgtgttttagtgaatctgctctcccagctcacacactcccctgcctcccatggcttacacactaggatccagactccatggtttgacaccagcctgcgtttgcagcttctctgtcacttccatgactctatcctcataccaccactgctgcttcccacccagctgagaatgccccctcctccctgactcctctctgcccatgcaaattagctcacatctttcctcctgctgcaatccatcccttcctcccattggcctctccttgccaaatctaaatactttatatagggatggcagagagttcccatctcatctgtcagccacagtcatttggtactggctacctggagccttatcttctgaagggttttaaagaatggccaattagctgagaagaattatctaatcaattagtgatgtctgccatggatgcagtagaggaaagtggtggtacaagtgccatgattgattagcaatgtctgcactggatacggaaaaaagaaggtgcttgcaggtttacagtgtatatgtgggctattgaagagccctctgagctcggttgctagcaggagagcatgcccatattggcttactttgtctgccacagacacagacagagggagttgggacatgcatgctatggggaccctcttgttggacacctaattggatgcctcttcatgagaggcctccttttcttcaccttttatgctgcactcctcccctagtttacacatcttgatgctgtggctcagtttgccttcctgaatttttattgggtccctgttttctctcctaacatgctgagattctgcatccccacagcctaaactgagccagtggccaaacaaccgtgctcagcctgtttctctctgccctctagagcaaggcccaccaggtccatccaggaggctctcctgacctcaagtccaacaacagtgtccacactagtcaaggttcagcccagaaaacagaaagcactctaggaatcttaggcagaaagggattttatctaaatcactggaaaggctggaggagcagaaggcagaggccaccactggactattggtttcaatattagaccactgtagccgaatcagaggccagagagcagccactgctactgctaatgccaccactacccctgccatcactgccccacatggacaaaactggagtcgagacctaggttagattcctgcaaccacaaacatccatcagggatggccagctgccagagctgcgggaagacggatcccacctccctttcttagcagaatctaaattacagccagacctctggctgcagaggagtctgagacatgtatgattgaatgggtgccaagtgccagggggcggagtccccagcagatgcatcctggccatctgttgcgtggatgagggagtgggtctatctcagaggaaggaacaggaaacaaagaaaggaagccactgaacatcccttctctgctccacaggagtgtcttagacagcctgactctccacaaaccactgttaaaacttacctgctaggaatgctagattgaatgggatgggaagagccttccctcattattgtcattcttggagagaggtgagcaaccaagggaagctcctctgattcacctagaacctgttctctgccgtctttggctcagcctacagagactagagtaggtgaagggacagaggacagggcttctaatacctgtgccatattgacagcctccatccctgtcccccatcttggtgctgaaccaacgctaagggcaccttcttagactcacctcatcgatactgcctggtaatccaaagctagaactctcaggaccccaaactccacctcttggattggccctggctgctgccacacacatatccaagagctcagggccagttctggtgggcagcagagacctgctctgccaagttgtccagcagcagagtggccctggcctgggcatcacaagccagtgatgctcctgggaagaccaggtggcaggtcgcagttgggtaccttccattcccaccacacagactctgggcctccccgcaaaatggctccagaattagagtaattatgagatggtgggaaccagagcaactcaggtgcatgatacaaggagaggttgtcatctgggtagggcagagaggagggcttgctcatctgaacaggggtgtatttcattccaggccctcagtctttggcaatggccaccctggtgttggcatattggccccactgtaacttttgggggcttcccggtctagccacaccctcggatggaaagacttgactgcataaagatgtcagttctccctgagttgattgataggcttaatggtcaccctaaaaacacccacatatgcttttcgatggaaccagataagttgacgctaaagttcttatggaaaaatacacacgcaatagctaggaaaacacagggaaagaagagttctgagcagggcctagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtgtttaatttttaaaaagtttttattgagatacaagtcaataccataaagctctcacccttctaaagtgtacaattcagtggtgtgagtatattcataagatttatacttggtgtctattcataagacttatatccagcatattcataactagagccatatcacagatgcattcatcataataattccagacattttcatcaccctaaaaggaaaccctgaaacccattagcagtcattccccattcctccaacccattctctccctaatccctagaaaccaccaatctgctgtgtatttcatctattgccaacatttcatataaatggcatcatacaata

SEQ ID NO: 11991 - DNA, 1479 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgaagccacttggaagggtttctccagacatgtgactgtttgctttgtgctttcatagtcgtgaaactgttgtcttacatttagtggccattcatgttctctctctgggaattgtctgtttatgtcccttgtgcattattttctcttgggttagctgtcttgttactgatttgttgaagctctttatatattgtggatactgatccttatttagttaatataatgcattcttccaatagtcttccagtctgtgtcttgggcttttgctttgtttaaaggttatttgtaggacaaaatatctacagtttaatgtactcagatatatcctttgaaaaatgagttattctttgtgtgtcttaagaagtctttccctatcctgccaggtgcagtggctcatggctggaatcccagcactttgagtggccgaggcaggtggatcacttgaggtcaggagttcaagaccagcctggccaacatggtgaaaccctgtctctactaaaaatacaaaatgtagccgggcgtggtggtacacacctgtaattccagttactcgggaggctgaggcaggagaatctcttgaacccaggaggcagaggttgcagtaagccaagattgcaccactgcactccagcctgggtgacagagccagactccatctcaagg

SEQ ID NO: 11992 - DNA, 358 bp, Homo sapiens
  misc_feature (12)..(12): n is a, c, g, or t
ccgcctactacnactaaattcgcggccgcgtcgactttttattgagatacaagtcaataccataaagctctcacccttctaaagtgtacaattcagtggtgtgagtatattcataagatttatacttggtgtctattcataagacttatatccagcatattcataactagagccatatcacagatgcattcatcataataattccagacattttcatcaccctaaaaggaaaccctgaaacccattagcagtcattccccattcctccaacccattctctccctaatccctagaaaccaccaatctgctgtgtatttcatctattgccaacatttcatataaatggcatcatacaata

SEQ ID NO: 11993 - DNA, 920 bp, Homo sapiens
aggctgagctcggcaccaacaccgccctccatcctgtgtcctcagtgccctccctaactcacagcgcttcacaccaacaggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgaagccacttggaagggtttctccagacatgtgactgtttgctttgtgctttcatagtcgtgaaactgttgtcttacatttagtggccattcatgttctctctctgggaattgtctgtttatgtcccttgtgcattattttctcttgggttagctgtcttgttactgatttgttgaagctctttatatattgtggatactgatccttatttagttaatataatgcattcttccaatagtcttccagtctgtgtcttgggcttttgctttgtttaaaggttatttgtaggacaaaatatctacagtttaatgtactcagatatatcctttgaaaaatgagttattctttgtgtgtcttaagaagtctttccctatcctgccaggtgcagtggctcatggctggaatcccagcactttgagtggccgaggcaggtggatcacttgaggtcaggagttcaagaccagcctggccaacatggtgaaaccctgtctctactaaaaatacaaaatgtagccgggcgtggtggtacacacctgtaattccagttactcgggaggctgaggcaggagaatctcttgaacccaggaggcagaggttgcagtaagccaagattgcaccactgcactccagcctgggtgacagagccagactccatctcaagg

SEQ ID NO: 11994 - DNA, 6388 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccatcgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcacgtagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcagtgtaccaagatctccaaggggagaggctccctacccccacagcacgggctggaactcctgactgtgtatgcctgggagcagggcgggaaggactcccagttcaacatggctgagggcttccgcacggtcctggagctggtcacccagtaccgccagctctgtatctactggaccatcaactacaacgccaaggacaagactgttggagacttcctgaaacagcagcttcagaagcccaggcctatcatcctggatccggctgacccgacaggcaacctgggccacaatgcccgctgggacctgctggccaaggaagctgcagcctgcacatctgccctgtgctgcatgggacggaatggcatccccatccagccatggccagtgaaggctgctgtgtgaagttgagaaaatcagcggtcctactggatgaagagaagatggacaccagccctcagcatgaggaaattcagggtcccctaccagatgagagagattgtgtacatgtgtgtgtgagcacatgtgtgcatgtgtgtgcacacgtgtgcatgtgtgtgttttagtgaatctgctctcccagctcacacactcccctgcctcccatggcttacacactaggatccagactccatggtttgacaccagcctgcgtttgcagcttctctgtcacttccatgactctatcctcataccaccactgctgcttcccacccagctgagaatgccccctcctccctgactcctctctgcccatgcaaattagctcacatctttcctcctgctgcaatccatcccttcctcccattggcctctccttgccaaatctaaatactttatatagggatggcagagagttcccatctcatctgtcagccacagtcatttggtactggctacctggagccttatcttctgaagggttttaaagaatggccaattagctgagaagaattatctaatcaattagtgatgtctgccatggatgcagtagaggaaagtggtggtacaagtgccatgattgattagcaatgtctgcactggatacggaaaaaagaaggtgcttgcaggtttacagtgtatatgtgggctattgaagagccctctgagctcggttgctagcaggagagcatgcccatattggcttactttgtctgccacagacacagacagagggagttgggacatgcatgctatggggaccctcttgttggacacctaattggatgcctcttcatgagaggcctccttttcttcaccttttatgctgcactcctcccctagtttacacatcttgatgctgtggctcagtttgccttcctgaatttttattgggtccctgttttctctcctaacatgctgagattctgcatccccacagcctaaactgagccagtggccaaacaaccgtgctcagcctgtttctctctgccctctagagcaaggcccaccaggtccatccaggaggctctcctgacctcaagtccaacaacagtgtccacactagtcaaggttcagcccagaaaacagaaagcactctaggaatcttaggcagaaagggattttatctaaatcactggaaaggctggaggagcagaaggcagaggccaccactggactattggtttcaatattagaccactgtagccgaatcagaggccagagagcagccactgctactgctaatgccaccactacccctgccatcactgccccacatggacaaaactggagtcgagacctaggttagattcctgcaaccacaaacatccatcagggatggccagctgccagagctgcgggaagacggatcccacctccctttcttagcagaatctaaattacagccagacctctggctgcagaggagtctgagacatgtatgattgaatgggtgccaagtgccagggggcggagtccccagcagatgcatcctggccatctgttgcgtggatgagggagtgggtctatctcagaggaaggaacaggaaacaaagaaaggaagccactgaacatcccttctctgctccacaggagtgtcttagacagcctgactctccacaaaccactgttaaaacttacctgctaggaatgctagattgaatgggatgggaagagccttccctcattattgtcattcttggagagaggtgagcaaccaagggaagctcctctgattcacctagaacctgttctctgccgtctttggctcagcctacagagactagagtaggtgaagggacagaggacagggcttctaatacctgtgccatattgacagcctccatccctgtcccccatcttggtgctgaaccaacgctaagggcaccttcttagactcacctcatcgatactgcctggtaatccaaagctagaactctcaggaccccaaactccacctcttggattggccctggctgctgccacacacatatccaagagctcagggccagttctggtgggcagcagagacctgctctgccaagttgtccagcagcagagtggccctggcctgggcatcacaagccagtgatgctcctgggaagaccaggtggcaggtcgcagttgggtaccttccattcccaccacacagactctgggcctccccgcaaaatggctccagaattagagtaattatgagatggtgggaaccagagcaactcaggtgcatgatacaaggagaggttgtcatctgggtagggcagagaggagggcttgctcatctgaacaggggtgtatttcattccaggccctcagtctttggcaatggccaccctggtgttggcatattggccccactgtaacttttgggggcttcccggtctagccacaccctcggatggaaagacttgactgcataaagatgtcagttctccctgagttgattgataggcttaatggtcaccctaaaaacacccacatatgcttttcgatggaaccagataagttgacgctaaagttcttatggaaaaatacacacgcaatagctaggaaaacacagggaaagaagagttctgagcagggcctagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccattctctccctaatccctagaaaccaccaatctgctgtgtatttcatctattgccaacatttcatataaatggcatcatacaata

SEQ ID NO: 11995 - DNA, 1180 bp, Homo sapiens
  misc_feature (71)..(71): n is a, c, g, or t
gggccaagtaaacttataacgggtctctaaggtaggcgagggccctgggtggcggggtacctttcccagtntcccccaaccaacagcagaactctgggcctccccgcaaaatggctccagaattagagtaattatgagatggtgggaaccagagcaactcaggtgcatgatacaaggagaggttgtcatctgggtagggcagagaggagggcttgctcatctgaacaggggtgtatttcattccaggccctcagtctttggcaatggccaccctggtgttggcatattggccccactgtaacttttgggggcttcccggtctagccacaccctcggatggaaagacttgactgcataaagatgtcagttctccctgagttgattgataggcttaatggtcaccctaaaaacacccacatatgcttttcgatggaaccagataagttgacgctaaagttcttatggaaaaatacacacgcaatagctaggaaaacacagggaaagaagagttctgagcagggcctagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtgtttaatttttaaaaagtttttattgagatacaagtcaataccataaagctctcacccttctaaagtgtacaattcagtggtgtgagtatattcataagatttatacttggtgtctattcataagacttatatccagcatattcataactagagccatatcacagatgcattcatcataataattccagacattttcatcaccctaaaaggaaaccctgaaacccattagcagtcattccccattcctccaacccattctctccctaatccctagaaaccaccaatctgctgtgtatttcatctattgccaacatttcatataaatggcatcatacaata

SEQ ID NO: 11996 - DNA, 504 bp, Homo sapiens
  misc_feature (12)..(12): n is a, c, g, or t
ccgcctactacnactaaattcgcggccgcgtcgacgtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtgtttaatttttaaaaagtttttattgagatacaagtcaataccataaagctctcacccttctaaagtgtacaattcagtggtgtgagtatattcataagatttatacttggtgtctattcataagacttatatccagcatattcataactagagccatatcacagatgcattcatcataataattccagacattttcatcaccctaaaaggaaaccctgaaacccattagcagtcattccccattcctccaacccattctctccctaatccctagaaaccaccaatctgctgtgtatttcatctattgccaacatttcatataaatggcatcatacaata

SEQ ID NO: 11997 - DNA, 3239 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccatcgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcacgtagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcaggttcggcacatggataggccaccttcctaagttgccctgggatctgcctctggagcactttcctgggaggaagcagggcccagccctggccaagatcctgggttggtggagcagagcagaaagagtgctatatctcagctgtgggaccttagttttcttatctgtaagatgggggtgataaaactatgtcacagg

SEQ ID NO: 11998 - DNA, 1618 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccggtaagtgagggggccccaggacccttgggttttgcactttgtttatgtgtccagtgtttcctgagcatctactatgtgccatatggtgtggaacaggctttaaaaagcaggggtggccaggtgtggtggctcacgcctgtaatctcaacacattgggaggccgaggtgggcagattacctgaggtcagaggtcaggagttcgagaccagtctggacaatatggtgaaaccttgtctctactaaaaatacgaaaattagccaggcatggtggtgggtgcgtgtaatctcagctactcgagaggctgaggcaggagaattgcttgaactagggaggcggaggttgcaatgagctgagatcactccattgcactccagcctgggtgacagagtaagactccgtcccaaaaaaa

SEQ ID NO: 11999 - DNA, 1080 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtgaggggttcctagaccattccagggttgggggcaaaagatcattgggaacaacacaggacttccaattctagcccagccaccaacttgctgtttgacctgggccagcctctacccctctctcagcctcagtctggggactaaacatattggacttgtgccagacaaaggcagagaaaccccagttcctcctggatctgtggtcctgctgtcaagatgcttggccctcccacaggcatctgggagtttccctcagccactgcctggagcggttactgctcagcccttccacaaatactcccgaaagctaagccaagtggacatgtggctagcagtaggggcctggggacgaaaccagaattctgcaaaatcttgtattttatgttgaaaacatcaatgtgatttttgtgttctccttcgtaatacacgtatgcttgagtt

SEQ ID NO: 12000 - DNA, 7735 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccatcgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcacgtagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcagtgtaccaagatctccaaggggagaggctccctacccccacagcacgggctggaactcctgactgtgtatgcctgggagcagggcgggaaggactcccagttcaacatggctgagggcttccgcacggtcctggagctggtcacccagtaccgccagctctgtatctactggaccatcaactacaacgccaaggacaagactgttggagacttcctgaaacagcagcttcagaagcccaggcctatcatcctggatccggctgacccgacaggcaacctgggccacaatgcccgctgggacctgctggccaaggaagctgcagcctgcacatctgccctgtgctgcatgggacggaatggcatccccatccagccatggccagtgaaggctgctgtgtgaagttgagaaaatcagcggtcctactggatgaagagaagatggacaccagccctcagcatgaggaaattcagggtcccctaccagatgagagagattgtgtacatgtgtgtgtgagcacatgtgtgcatgtgtgtgcacacgtgtgcatgtgtgtgttttagtgaatctgctctcccagctcacacactcccctgcctcccatggcttacacactaggatccagactccatggtttgacaccagcctgcgtttgcagcttctctgtcacttccatgactctatcctcataccaccactgctgcttcccacccagctgagaatgccccctcctccctgactcctctctgcccatgcaaattagctcacatctttcctcctgctgcaatccatcccttcctcccattggcctctccttgccaaatctaaatactttatatagggatggcagagagttcccatctcatctgtcagccacagtcatttggtactggctacctggagccttatcttctgaagggttttaaagaatggccaattagctgagaagaattatctaatcaattagtgatgtctgccatggatgcagtagaggaaagtggtggtacaagtgccatgattgattagcaatgtctgcactggatacggaaaaaagaaggtgcttgcaggtttacagtgtatatgtgggctattgaagagccctctgagctcggttgctagcaggagagcatgcccatattggcttactttgtctgccacagacacagacagagggagttgggacatgcatgctatggggaccctcttgttggacacctaattggatgcctcttcatgagaggcctccttttcttcaccttttatgctgcactcctcccctagtttacacatcttgatgctgtggctcagtttgccttcctgaatttttattgggtccctgttttctctcctaacatgctgagattctgcatccccacagcctaaactgagccagtggccaaacaaccgtgctcagcctgtttctctctgccctctagagcaaggcccaccaggtccatccaggaggctctcctgacctcaagtccaacaacagtgtccacactagtcaaggttcagcccagaaaacagaaagcactctaggaatcttaggcagaaagggattttatctaaatcactggaaaggctggaggagcagaaggcagaggccaccactggactattggtttcaatattagaccactgtagccgaatcagaggccagagagcagccactgctactgctaatgccaccactacccctgccatcactgccccacatggacaaaactggagtcgagacctaggttagattcctgcaaccacaaacatccatcagggatggccagctgccagagctgcgggaagacggatcccacctccctttcttagcagaatctaaattacagccagacctctggctgcagaggagtctgagacatgtatgattgaatgggtgccaagtgccagggggcggagtccccagcagatgcatcctggccatctgttgcgtggatgagggagtgggtctatctcagaggaaggaacaggaaacaaagaaaggaagccactgaacatcccttctctgctccacaggagtgtcttagacagcctgactctccacaaaccactgttaaaacttacctgctaggaatgctagattgaatgggatgggaagagccttccctcattattgtcattcttggagagaggtgagcaaccaagggaagctcctctgattcacctagaacctgttctctgccgtctttggctcagcctacagagactagagtaggtgaagggacagaggacagggcttctaatacctgtgccatattgacagcctccatccctgtcccccatcttggtgctgaaccaacgctaagggcaccttcttagactcacctcatcgatactgcctggtaatccaaagctagaactctcaggaccccaaactccacctcttggattggccctggctgctgccacacacatatccaagagctcagggccagttctggtgggcagcagagacctgctctgccaagttgtccagcagcagagtggccctggcctgggcatcacaagccagtgatgctcctgggaagaccaggtggcaggtcgcagttgggtaccttccattcccaccacacagactctgggcctccccgcaaaatggctccagaattagagtaattatgagatggtgggaaccagagcaactcaggtgcatgatacaaggagaggttgtcatctgggtagggcagagaggagggcttgctcatctgaacaggggtgtatttcattccaggccctcagtctttggcaatggccaccctggtgttggcatattggccccactgtaacttttgggggcttcccggtctagccacaccctcggatggaaagacttgactgcataaagatgtcagttctccctgagttgattgataggcttaatggtcaccctaaaaacacccacatatgcttttcgatggaaccagataagttgacgctaaagttcttatggaaaaatacacacgcaatagctaggaaaacacagggaaagaagagttctgagcagggcctagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtgtttaatttttaaaaagtttttattgagatacaagtcaataccataaagctctcacccttctaaagtgtacaattcagtggtgtgagtatattcataagatttatacttggtgtctattcataagacttatatccagcatattcataactagagccatatcacagatgcattcatcataataattccagacattttcatcaccctaaaaggaaaccctgaaacccattagcagtcattccccattcctccaacccattctctccctaatccctagaaaccaccaatctgctgtgtatttcatctattgccaacatttcatataaatggcatcatacaataaaaaaaaaaaaaaaaaaaaaaaaaaaaaaaaaaaaaaaaaaaaaaaaaaaaaaaaaaaaaacaaaaaaaaaaaaaaagaagagagcgggggcgcgcgcgcagcacgaagacactctctccccgggagggcggcccacacacccgccccgcccaccctttctttgtgtaaaaacagcgggcggccccaaaggagggcgtgttttatatataccgcagacgacacggccggcgcgggttcaacaagcaagcgagcgacggggggagaacaaacacgcgcgcacgggagagcatccttgaggagcacgacgagcaccccctaccactctgcgcgggggggagcggcacaaagagaggggaagcaaacaccacacatacccgacacgctccacacacaccagcgccgcagagagaacaacacaaacaacccatgcgaggcgcggaagacaatagagaggggacaagaaaacacaaaacagcagcagaataatactcagccgaccgcccgacgaacaaacaaccagcggacggcccaccccgacgcacaaccgaaacacacacagccacaccacaatatcacaatcaactccacacagagggcgacgcagcgacaatacacaccaaaaaacaaccacgacgtgcgcaccgagcactcatagaccaaagcaacacggccgaccgcacacccggcagtcacaccctccacagacccagagcgcgaaacccacacctgagcagcagtaagagaggaagagagaggcagacggaacggaaggcaggcgacggagccgaaggagcggcaaagcggagcggcagcgcacaacgagggcaggcggaggagagaccagcgctcgacgcgacggaagggggggaggccgtacggagctgggtgcgatggcaacgaaggagagaagcggagcacacgaaagcgaacaaaaacagccacagagcaaaacggcccagccaagcacccacacagaccgagctcggagagggagaacggcaaaacacgcgaca

SEQ ID NO: 12001 - DNA, 1495 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtgaggggttcctagaccattccagggttgggggcaaaagatcattgggaacaacacaggacttccaattctagcccagccaccaacttgctgtttgacctgggccagcctctacccctctctcagcctcagtctggggactaaacatattggacttgtgccagacaaaggcagagaaaccccagttcctcctggatctgtggtcctgctgtcaagatgcttggccctcccacaggcatctgggagtttccctcagccactgcctggagcggttactgctcagcccttccacaaatactcccgaaagctaagccaagtggacatgtggctagcagtaggggcctggggacgaaaccagaattctgcaaaatcttgtattttatgttgaaaacatcaatgtgatttttgtgttctccttcgtaatacacgtatgcttgagttaagataaaaataggcctctgtgtcctcatctgtaaaatgaggataatactaatggggataatagtaatcttatagagttgtcagaagaattaaatgcattaatatatgtaatcaagcttagaagtgtgtctagtgggccaggcgcagtggctcatgcctgtaatcccagctttgggaggccaagttagagactgcttgagcccaggagttcaagatcagccttggcaaaatagcaagatctagtctctacaaataataataattttaaaaaatagccaggtgtagtagtacatgcctccctctgatcccagctactggagaggctgaggtgggaggattgtttgagcccaggcagtggaggctgcagtgaattgtgattttgccactacaatctgtctgagtaagactcttctta

SEQ ID NO: 12002 - DNA, 2104 bp, Homo sapiens
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccatcgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcacgtagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgattggaagatgtgccaaagagtggtttcttctagaagtttgaatttgtagctacagtttccaagaagaaaaatagtagttggataatttagtaaaataataacatcattttcattttcttacctattcttaactttggtttctcaaaggaagaaaatgagcaggtagcacattctccact

SEQ ID NO: 12003 - DNA, 382 bp, Homo sapiens
catgatctcagctcactgcaacctcctcttcccgggttcaagccattctcctgcctcaggctcccaagtagctgggattataggtgcacaccaccacgcctggctaatttttatatttttagtagagacggggttttgccatgttggccaggctggtctcgaactcctgacctcaggtgatccacctgcctcggcctcccaaagtgctaggtttacaggcatgagtcaccacgcctggctggctgcatttatttcttagggccgctcaaacaaacctgcaaactgagtggcttaaaataaatgtatcctctcatggttgtggaggctgggagtctgaggtcgaggtgtgggtgggcccagctcctcctgagatgctgaggtg

SEQ ID NO: 12004 - DNA, 509 bp, Homo sapiens
atcaagagaaaactcctcaacatgttcatttatctgataaattgaatcacagtacattgaggaaatctagaaatgttacccatgtttctccagaatccagccccacagatttttctgggattctcatcatccatagaaaggatattttaaatgggtgatgagcgagtgcttttgtcctgggttaatcctagatataactctacatgtgtgagttatgagcatagacaactggactaggagtttgaggggagctcaaagtagcacagctgactgagtggctttctacattcactgatggccaactgaatctctttcaattcactgagaaccagatgaatctctgcttctggaacttgaaactaaagttaatccctttccacagatcagcagaatttaccatcaattttacttaaaaaatttatttaaatttaaaacacatttcaaaacaaatgcaggtcccacttttcacttttctaatacctagtttgaccagatttgctgagtagcta

SEQ ID NO: 12005 - DNA, 579 bp, Homo sapiens
ggatgcagaggttgcaatgagccaagatcatgccactgcactccagcctgggcgacagagcaagacctcaaggaaaaaagacaaaaaagaccttgctatttgccaggcaacccttcctacacataccattccctagggcagcaggttgtatcttcaggcagtagtcatagtttaagtcttattttgcaaaatgtccttgaaactaagttccgggtaaaataacgaccagtacacagagagtgaacatactctgttatgtaagataacatcactttatgcatcacacaactagttgactcattctcagcttaatgtggttagttttggtttttgttttcagtttccactgctactaagtcagacattctttttcctatacttctgttttttgctctgttttggcttcctgaatgcaagttcaggtcctaacagtgaagtgaggacagaaaaataaccttggatttgcctattttgtgaagtgatgggaaaggtagtcagttgagagactgttgagaagaagtaaggactgttaggacaactctttcaagaagattgaagactgagggagatgcagaggaa

SEQ ID NO: 12006 - DNA, 362 bp, Homo sapiens
ccttttttaacaatgaatagcataaagctgtccctttaaaaataaaattaaaatataaattttagttgtcccgggagttcttttgtatctgaaacctcagttgtcaagcttggaaatctgtacttttaaaatatcctcaagcgattctgattacacatcaggtttggaagcacttggcataaagaacttcccccacccaattcaaagaaatagtatttaagccctcataatgtgcagtgtggttaagctgtgtctttttccagtctagtctacctcaacactcttgtggacatgatttttgccaaaaatctgagtgagctttgggatgcattctacccccatgagatggctattttatccca

SEQ ID NO: 12007 - DNA, 2081 bp, Homo sapiens
cctaaatcaaatagtagtagcttttaaaaaaattactaaacttaatcaacactatttggaaagggggctagagtcagatattatgatcagttgatggctagctcaaggaatttttagaaatccccttccctacctccccagaatgtaccctacagccaaagtctcagcagcctacagggaaggaggctgaggagcaccctacatcagctcccctcacccattccctgctgcctccaacccctttatgggtggtttcccatttcatctttgatttaggggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagattctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaatagctatggactgttggatacaggatacagtggtgagaggagccccattttaggtctttcttttaggtttttggttttcattactccaagtagcccttgacccaagaacaaaggcttgttgtatgagttccactgccagatttatgggatgcctggatcattcagaaggatgcttcaactattatttgtcaggtccaaaggtcgtacttgataaccccattttctatgtatggggtagtctaatatattattttatctactttatttttcccttttcagaaagtccttagtgcaaaccaccattggaatctagtcagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggta

SEQ ID NO: 12008 - DNA, 5092 bp, Homo sapiens
gggaccatcctggctaacacgcggtaaaacatcatctctactaaaaatacaaaaaaattagccaggcgtggtagcaggcacctgttgtcccagctactcgggaggctgaggcaggagaatggcgtgaacccaggaggcggagctggcagtgagctgagatcacaccactgcaatccagcctgggcgacaaagcaagactctgtctcaaaaaaaaaaaatcaattcaggccaagtgtggtggtgcacacctgtagtcccagctactgggaaagctgaagaagtgggaggatagcttgggcccaggagatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagattctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaatagctatggactgttggatacaggatacagtggtgagaggagccccattttaggtctttcttttaggtttttggttttcattactccaagtagcccttgacccaagaacaaaggcttgttgtatgagttccactgccagatttatgggatgcctggatcattcagaaggatgcttcaactattatttgtcaggtccaaaggtcgtacttgataaccccattttctatgtatggggtagtctaatatattattttatctactttatttttcccttttcagaaagtccttagtgcaaaccaccattggaatctagtcagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggta

SEQ ID NO: 12009 - DNA, 1152 bp, Homo sapiens
gggaccatcctggctaacacgcggtaaaacatcatctctactaaaaatacaaaaaaattagccaggcgtggtagcaggcacctgttgtcccagctactcgggaggctgaggcaggagaatggcgtgaacccaggaggcggagctggcagtgagctgagatcacaccactgcaatccagcctgggcgacaaagcaagactctgtctcaaaaaaaaaaaatcaattcaggccaagtgtggtggtgcacacctgtagtcccagctactgggaaagctgaagaagtgggaggatagcttgggcccaggagatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggtaggtgcggggagccggcagccgagacaggtgcgccgcggcgggagacccactcttctacccagcaaggggcgcttccgcggagttgggcacctctctgtttccacgcctctccttccccctttccccctctcctcccggggatgtctgtcttctccccatcctatcattccaggctggagggcagcaacgcctgctttcccctgtggcaggagagaagcactgggtccctaaggtcagagcaacagaaattttgtctgtgtgtgtgtgtgtgtgtgtgtgtgtgtgtgtgtgtgtgtgagagagagagagagagagagagagagaaagagagagagagaaagggttgcagactcagtgatgcttagttttcttaagagaagtcgtcaaagttgcccctaagcaggtgtcatcttcaaccacccttcccccaccttccagattt

SEQ ID NO: 12010 - DNA, 3528 bp, Homo sapiens
gggaccatcctggctaacacgcggtaaaacatcatctctactaaaaatacaaaaaaattagccaggcgtggtagcaggcacctgttgtcccagctactcgggaggctgaggcaggagaatggcgtgaacccaggaggcggagctggcagtgagctgagatcacaccactgcaatccagcctgggcgacaaagcaagactctgtctcaaaaaaaaaaaatcaattcaggccaagtgtggtggtgcacacctgtagtcccagctactgggaaagctgaagaagtgggaggatagcttgggcccaggagatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagcaggtctccttcctgccacctagtgaagaagttgcctttcttccctttgccttccagcatgattgtaaagcttcctgaggcctccccagccatgctgaactgtgagtcaattaaacctcattataaattatccagtctcaa

SEQ ID NO: 12011 - DNA, 4316 bp, Homo sapiens
ggataacctccagagagaaggctttgtaaactggaagtgactggcgcgagtggctttcacttatacacaaacacagcgttttgtcatctgggagtgctgaaaggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaaaaagagccgcagaagctaaagaggtgaaggaccatgaagtgccccttggaaatgcaggttgtcagacttctgttgcttctagtcagaattcaagttgtggagatggtattcagcagacccaagacaaggaaactactccaggaaaactctgtagaactcaaaaaagccaacacgtgtccccaaagatacgtccagtttatgatggatactgtccaaattgccagatgcctttttcctcattgatagggcagacacctcgatggcatgtttttgaatgtttggattctccaccacgctctgaaacagagtgtcctgatggtcttctgtgtacctcaaccattccttttcattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttaaaaagtctccgtctctgactgaagccagtgaaaagatttctactcatatccaaacatcccaacaagctctacaatttacagattttgttgagaatgacaaactagtgggagttgctttgcgtcttgcaaacaactcagaacacataaatttgccattgccagaaaatgacttcagtgactgtgaaatctcctattctccacttcaaagtgatgaagacactcatgatatcgatgaaaaaccggatgattcacaagaacaactgttttttaccgaaagctcaaaagatggcagcctcgaagaagatgatgacagctgtggtttttttaaaaaacgacatggtcccttactgaaggaccaggatgagagctgccccaaagtgaacagcttcttaactcgggataagtatgatgaaggattgtatagattcaatagtctaaatgatttgtctcaacctatttctcaaaataatgagagtactttgccttatgatctggcatgtactggtggtgattttgtgttgtttccacctgcattggcagggaagcttgctgcttctgttcatcaggcaactaaagcaaaacctgatgagccagaatttcactcagctcaatcaaataaacagaaacaggtaattgaagaatcatctgtttacaatcaagtttctcttccgttagttaagagtttaatgttgaaaccttttgaaagtcaggtagaagggtatctttcttcccaaccaacccaaaatacaattagaaaattatcaagtgagaacttgaatgctaagaataatactaactcagcatgtttctgcagaaaggcattagagggtgtgccagttggtaaagctacaattttaaatacagaaaacttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataaacttaaatccagttccaagtcctaatcaaaagaggtcctcgcagtgcaagaggaaagcagaaaaatctttaagtgatttagaatttgatgcaagtactttacatgagagtcagctttctgtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggaaccggctttacagttgatgcctttcagtatggcgtggttgaaggttgcacagcctattttctcacacattttcattctgatcattatgctggattgtctaaacacttcacatttccagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctaatggtactgtcatattacacacgggagacttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttctcccaatgatgcaaattaattttaagggcttacagagtcatttgaagaagtgtggtgggaaatacaatcagattttggcatttcgacctacaggatggacacactctaacaagttcactagaatagcagatgttattccccagaccaaaggaaacatttcaatatatggaattccttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcagtagtagttaagttccttggatgtagcttgttagtagttaaatctatagaaatgtgaaatacactttgtgtggaaaaacctcatgaagattgttcagatactttattttctcatttatgtttgaacaacatgttcgtggtgctgaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcattatatatataagtaattatgtgtctttaaaattatgagatgaaacttttatatgacgtgtatacttaaataaaattaatataaaattt

SEQ ID NO: 12012 - DNA, 4254 bp, Homo sapiens
gcactggcagcgggaacttgttcccgccaagaccctaaagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaaaaagagccgcagaagctaaagaggtgaaggaccatgaagtgccccttggaaatgcaggttgtcagacttctgttgcttctagtcagaattcaagttgtggagatggtattcagcagacccaagacaaggaaactactccaggaaaactctgtagaactcaaaaaagccaacacgtgtccccaaagatacgtccagtttatgatggatactgtccaaattgccagatgcctttttcctcattgatagggcagacacctcgatggcatgtttttgaatgtttggattctccaccacgctctgaaacagagtgtcctgatggtcttctgtgtacctcaaccattccttttcattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttaaaaagtctccgtctctgactgaagccagtgaaaagatttctactcatatccaaacatcccaacaagctctacaatttacagattttgttgagaatgacaaactagtgggagttgctttgcgtcttgcaaacaactcagaacacataaatttgccattgccagaaaatgacttcagtgactgtgaaatctcctattctccacttcaaagtgatgaagacactcatgatatcgatgaaaaaccggatgattcacaagaacaactgttttttaccgaaagctcaaaagatggcagcctcgaagaagatgatgacagctgtggtttttttaaaaaacgacatggtcccttactgaaggaccaggatgagagctgccccaaagtgaacagcttcttaactcgggataagtatgatgaaggattgtatagattcaatagtctaaatgatttgtctcaacctatttctcaaaataatgagagtactttgccttatgatctggcatgtactggtggtgattttgtgttgtttccacctgcattggcagggaagcttgctgcttctgttcatcaggcaactaaagcaaaacctgatgagccagaatttcactcagctcaatcaaataaacagaaacaggtaattgaagaatcatctgtttacaatcaagtttctcttccgttagttaagagtttaatgttgaaaccttttgaaagtcaggtagaagggtatctttcttcccaaccaacccaaaatacaattagaaaattatcaagtgagaacttgaatgctaagaataatactaactcagcatgtttctgcagaaaggcattagagggtgtgccagttggtaaagctacaattttaaatacagaaaacttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataaacttaaatccagttccaagtcctaatcaaaagaggtcctcgcagtgcaagaggaaagcagaaaaatctttaagtgatttagaatttgatgcaagtactttacatgagagtcagctttctgtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggaaccggctttacagttgatgcctttcagtatggcgtggttgaaggttgcacagcctattttctcacacattttcattctgatcattatgctggattgtctaaacacttcacatttccagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctaatggtactgtcatattacacacgggagacttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttctcccaatgatgcaaattaattttaagggcttacagagtcatttgaagaagtgtggtgggaaatacaatcagattttggcatttcgacctacaggatggacacactctaacaagttcactagaatagcagatgttattccccagaccaaaggaaacatttcaatatatggaattccttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcagtagtagttaagttccttggatgtagcttgttagtagttaaatctatagaaatgtgaaatacactttgtgtggaaaaacctcatgaagattgttcagatactttattttctcatttatgtttgaacaacatgttcgtggtgctgaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcattatatatataagtaattatgtgtctttaaaattatgagatgaaacttttatatgacgtgtatacttaaataaaattaatataaaattt

SEQ ID NO: 12013 - DNA, 4467 bp, Homo sapiens
ggactctgagggctttttggagctcgctatgcttaacctggagatgattaaggccccgcttcctggcctcccagcctctaatgccaaaagataagggagaggctggcgtgtgaccccgttttgagtcaggtggacagagggctggccaccttcggaaccatgggtgcaatacggagtcagacctcaatacaagcccactctttcacatatttgaacttttttcacatatcaactttttttgttcactgtgcagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaaaaagagccgcagaagctaaagaggtgaaggaccatgaagtgccccttggaaatgcaggttgtcagacttctgttgcttctagtcagaattcaagttgtggagatggtattcagcagacccaagacaaggaaactactccaggaaaactctgtagaactcaaaaaagccaacacgtgtccccaaagatacgtccagtttatgatggatactgtccaaattgccagatgcctttttcctcattgatagggcagacacctcgatggcatgtttttgaatgtttggattctccaccacgctctgaaacagagtgtcctgatggtcttctgtgtacctcaaccattccttttcattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttaaaaagtctccgtctctgactgaagccagtgaaaagatttctactcatatccaaacatcccaacaagctctacaatttacagattttgttgagaatgacaaactagtgggagttgctttgcgtcttgcaaacaactcagaacacataaatttgccattgccagaaaatgacttcagtgactgtgaaatctcctattctccacttcaaagtgatgaagacactcatgatatcgatgaaaaaccggatgattcacaagaacaactgttttttaccgaaagctcaaaagatggcagcctcgaagaagatgatgacagctgtggtttttttaaaaaacgacatggtcccttactgaaggaccaggatgagagctgccccaaagtgaacagcttcttaactcgggataagtatgatgaaggattgtatagattcaatagtctaaatgatttgtctcaacctatttctcaaaataatgagagtactttgccttatgatctggcatgtactggtggtgattttgtgttgtttccacctgcattggcagggaagcttgctgcttctgttcatcaggcaactaaagcaaaacctgatgagccagaatttcactcagctcaatcaaataaacagaaacaggtaattgaagaatcatctgtttacaatcaagtttctcttccgttagttaagagtttaatgttgaaaccttttgaaagtcaggtagaagggtatctttcttcccaaccaacccaaaatacaattagaaaattatcaagtgagaacttgaatgctaagaataatactaactcagcatgtttctgcagaaaggcattagagggtgtgccagttggtaaagctacaattttaaatacagaaaacttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataaacttaaatccagttccaagtcctaatcaaaagaggtcctcgcagtgcaagaggaaagcagaaaaatctttaagtgatttagaatttgatgcaagtactttacatgagagtcagctttctgtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggaaccggctttacagttgatgcctttcagtatggcgtggttgaaggttgcacagcctattttctcacacattttcattctgatcattatgctggattgtctaaacacttcacatttccagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctaatggtactgtcatattacacacgggagacttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttctcccaatgatgcaaattaattttaagggcttacagagtcatttgaagaagtgtggtgggaaatacaatcagattttggcatttcgacctacaggatggacacactctaacaagttcactagaatagcagatgttattccccagaccaaaggaaacatttcaatatatggaattccttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcagtagtagttaagttccttggatgtagcttgttagtagttaaatctatagaaatgtgaaatacactttgtgtggaaaaacctcatgaagattgttcagatactttattttctcatttatgtttgaacaacatgttcgtggtgctgaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcattatatatataagtaattatgtgtctttaaaattatgagatgaaacttttatatgacgtgtatacttaaataaaattaatataaaattt

SEQ ID NO: 12014 - DNA, 781 bp, Homo sapiens
cagctcagaggaactcacttgagaatgctggtttttatcagcaccccagccagcagagtgaggtctttggatcttgagctgcagtctctgagttgggcctccttcctcttttgtttcatcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 12015 - DNA, 1182 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 12016 - DNA, 1182 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacagccagttctctatcaaagggcatttatttggactgcttccacatttttttttaagctaacttattccctgacagacttttcttcaactcagcatgacttcaactctccaactacacctgttaccttcagtgacctggagcagttggctaaagagcaagacaaagaatcagagaaacaacttctactccaggaagtggagaatcacaaaaagcagatgctcaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaataga

SEQ ID NO: 12017 - DNA, 1155 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaataga

SEQ ID NO: 12018 - DNA, 1080 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 12019 - DNA, 1042 bp, Homo sapiens
  misc_feature (3)..(3): n is a, c, g, or t
cangctgtacccgtccggattcccgcgataaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 12020 - DNA, 1133 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 12021 - DNA, 1250 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacagccagttctctatcaaagggcatttatttggactgcttccacatttttttttaagctaacttattccctgacagacttttcttcaactcagcatgacttcaactctccaactacacctgttaccttcagtgacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaataga

SEQ ID NO: 12022 - DNA, 1580 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagttccttttaaaagatgtgaatcagaggctacaggagagactgcttgagaccatctggtttcctccaatagttttcccagagtgtctcctctgtgatggagaagagtatcagccctctccagggtccttcagtataagacaacagaaaaagggcgtttactccttgaaacgcttttggaaaattgcacacgtggacaaaaggagaaagcatggtatcctgaatcccctgagccctgagtccattaccccagccagtctcgtttcagttctaccctcagcccatcccccatctggattattttgaagcaaatcccagacatcatccataaatatctcagtacatctctctaaaagataagggactctttggggaaaaagcagaagcaaccccataactacaataccatgatcacccctagaaattataattttggaccactgttttttcagtgcaccaaataggcagaagcaaaaggaaagcaagcaggtgaccccaaggtcactccttgagtttgcagcttacctgaacatctgggctcggaaccagccaggggcttcctctcagcgtgtgctgtgggagaggccttggagagagagggagcaaggcgacaacttggcctctgagcccagggcttttatgctctggtgtggcgacagcataccccccgctaacagtgggaaggaaacacaaatgctggtggcttctggggtgttgagagggtcccggtgttcttggggcccattttgtacaagcgataactattgaagaaaagagaagaatacagttcttaaccctttccttatgcctcacaaattcagcttgatttaaaagcctactaggaccataattttaaaacaaaaagcttattaggaatatggtgtctggaatttgctccacaattgcaggagtagttgcagttggggggagggggagcaggatttcagaggttggtggttcttggttatgggtggtggacacatggcatttcatgatattatgctgtctgctctgtgatggttcaaaattctccgtaataataaagtttaaaaagaaaaaaaaaa

SEQ ID NO: 12023 - DNA, 1284 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacagccagttctctatcaaagggcatttatttggactgcttccacatttttttttaagctaacttattccctgacagacttttcttcaactcagcatgacttcaactctccaactacacctgttaccttcagtgacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaataga

SEQ ID NO: 12024 - DNA, 685 bp, Homo sapiens
cagctcagaggaactcacttgagaatgctggtttttatcagcaccccagccagcagagtgaggtctttggatcttgagctgcagtctctgagttgggcctccttcctcttttgtttcatcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcagctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 12025 - DNA, 1175 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaccaacaacaaaaaaaaaaaa

SEQ ID NO: 12026 - DNA, 1145 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggtactgatcccgggaccctaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 12027 - DNA, 1095 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaataga

SEQ ID NO: 12028 - DNA, 1042 bp, Homo sapiens
  misc_feature (1)..(1): n is a, c, g, or t
  misc_feature (3)..(4): n is a, c, g, or t
ngnngctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttcgatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaataga

SEQ ID NO: 12029 - DNA, 350 bp, Homo sapiens
gatagacagacagacccttaacatagctggatagtactgttgtaccggttgtacacctgacttaaaggtccattttgggtatagaaagaaatttgtcagaagggaattttttcttccttatctcagtgaggggctgatcctatttgtttgctttagttcttaccacttagaacttcgtggctaaatcatcttttgttcaaatctgagatccatctatatgaccttttggagagtaagttactctcttgaactagaagtttcttcttctgtaaactaggaataatatttgtattgcagaattgtgaaaagtaaataatgtggtaaggaaaataaagtacctaacatggttc

SEQ ID NO: 12030 - DNA, 363 bp, Homo sapiens
tgaagaggtttgaaactttcaccatattctcaaagggatatgtgaccctcgaaaacattagatgatgttttacccttccttaattagtttggcgttattgacttttttatgggttttctgtgcctttggttactgcagatcgttctacctcgccacgttaaattatagcttcagtataagatgagaaggcatagcatgctatttgatttatcctttatcatcatataacatgccttacaattgagcagctatggaaggtaaatatggagtatttacattccaaattttagtgcttgggtcaagtctatagacaataatgagaaaacagggtgagaacagcctacttatgtaaatacatgaatc

SEQ ID NO: 12031 - DNA, 1657 bp, Homo sapiens
gatctctagaatagtcttaagtcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttc

SEQ ID NO: 12032 - DNA, 1737 bp, Homo sapiens
cggggatgggagcgcgcaacgcggaagcgggcggcagaccggcgccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttc

SEQ ID NO: 12033 - DNA, 1626 bp, Homo sapiens
cggggatgggagcgcgcaacgcggaagcgggcggcagaccggcgccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttc

SEQ ID NO: 12034 - DNA, 465 bp, Homo sapiens
agcgcctgctgcattaggagctgggtattcctcttgacatctggatgttgctgggtcacgatgcctgcctcaggccaggagtctgcgggaactgtggggcagagagcacagagtctttgctgctctttaagcgattagtgcactgaagcagcaataatgttgaattatcgcctggctgctttcttctcaggaatcttgggacaataggagagtcaagaaggagcatttacagtaaagtcatgttcagagagacaagactaattatagagtattaaagagctttattttaaacgatttaatttacaaatagctctgggcagtgcatggaactttttagaaccataaacctgtagcttaaagagacttttctaatttaaagtggctagtatagaaacatattgtttcagcaattattcagttttagagtttgttcaagttgtgccatagaagattcagcatctagtt

SEQ ID NO: 12035 - DNA, 254 bp, Homo sapiens
ttgaacttactattcattgtcattttaagttttgtgtctgatatctttaatatctgaattcttgtggcccttctttcttggttattgaacattgtcttttaaaaaaatgtgcctacttcttttttattgctaccaaacattgtttgtcatagattttttgtgcaatggatttctttgatgatcacatgaagccagtaagcctttttccaactaatggttttaaatgcctaagaactttgattccaaaaaaaaaa

SEQ ID NO: 12036 - DNA, 323 bp, Homo sapiens
ttaaaggttttgggtttaattaaacagagttgtgtttaattcatttcagataaaactttatttttaattaaatggggaatggcatttagctatcttacctgaattcttttctgagaaactcttccataagaaaatgaaaacactgattttgtcctgtctcgagaacaagtatgcttttcaaatactacttttgtgcttctcttcattatggctcatggagccttcaacgagattctgtggtaacatatccagcatattggaaattacactgaaatccctctgtattatttcaagttattaaaaaagcttttgtgtcattttta

SEQ ID NO: 12037 - DNA, 332 bp, Homo sapiens
ttagagctcaatgctttgtcctctgtcatccttctactgcatccctttcttcgtttcctcacttcaactttttagtaaacttgtctgaggcattagctttactcttacgcattttgctcccctgcctttttgttataaatattatcatggcatgaaacaaaaagcctgttatctgcctttccatgatcactttggtgacactgtttcagccacaagtaaacctagcaactctatgaatagcaggacagacttgaatgtggtgtgtgtgcaaggaagttatttaactttcttaatcttaaatgccaccagaaaacattctgctccctgttact

SEQ ID NO: 12038 - DNA, 539 bp, Homo sapiens
aaagagaacattagatcctttatgttgtatactcagatacattttacatgggtcagagatttaaatataaaaaaatgaaaccagaggagaatttaattataaccttagaattataaagcctttctaaaattatgactcaaaatctggaagtcaaaagattggtaaatttgcctttaaaaatctctgtgataaaaaactaccataaggaaagtcaaaagagaaatacagtttttaaaacaattgacgcttatgttgccgacagttgtataaatggagagaaggaaagttagcacatgctcataaaaacattatagaaaaatgggcaaagggctgggcacagtgtttcacacctgtaatcccagcactttgggaggccgaggcaggtggatcacctgaggtcaaaagttcaagaccagcctggccaacatgatgaaacctcgtctctactaaaaatataagaaattagctgggcatggtggcgggtgcctgtactcccagctacttgggaggctgaggcaggagaatcgcttgaacccgga

SEQ ID NO: 12039 - DNA, 435 bp, Homo sapiens
gcaccacaccacacccaggacctggaataggtggaatggcagcccctcaaaatatatgtccatgtcttaatgccgagccgctgtgaatgtggccttatttggagaaggggtttttgcagattaattaaattaaggaccctgagatgagatcatcctgtattaccaaggtgggccccaaatccaatgacagatgtccttataagagacacaggaggagaagacacagacacagaggagaaggccctgtgaatacagaggcagaaactggagtacgcagccaccattcaaggcatttggtcagccacagaagctggaaaaggaagtggaatctctcctagagcctgtggagggagcacagccttgccaacacctcgacttcagatttctgttttccagaactctgagagaataaattgctgttgtttaagccactaa

SEQ ID NO: 12040 - DNA, 361 bp, Homo sapiens
ttttttttttgagacaaggtctcgctgttacccaggttggagtgcaatggtacaatcacagctcactgcagcctccacctcctgggctcaagtgatcctcccacttcagtcccctgagtagctgggactacaggcatgcaccactatgcctgggtaattttaaaatttttttgtagagacaaggtctcactatatggcccaggctggttttgaaccccagggctcaagtagtcctcctgcctcagcctcccaaagtgctggaattacaagcaggtgcctggcctgcaatatatttcttatctactaacttattaacttatctattaatttattcttcctatctaactgaaaaatttgtacc

SEQ ID NO: 12041 - DNA, 106 bp, Homo sapiens
ccagccttgtttttcctaaaaacccaagcattatcttttcatcatcactgtaccctccagaaagtatgaattaagcatttatctatctccattttgtcctgaacaa

SEQ ID NO: 12042 - DNA, 466 bp, Homo sapiens
tactaatgatgctgatctttgattacagactattttggatattagattgtcctacctaatttcacaacagtagtccaatccagctgtaaatttcctatctccacaaatttaacatggcagctgacatatattaatatattttagcatcagagtatcttctaagaattgttcaacttaaaaatccactttcaaatttgttgctttatgttatacaactgttgtaatacttcatactgataaaccgctttaaaataagtaagtagttaaccttcaaaccaagaactgacaggtattattacctccattttgcagatggaaaaacaggatgaaagattaaaatttttgtccaagaccataaaagccagctgtggatccctgggtgaatcttggagttgctaacttctgtattttgcttagtttattgagtaacaataccttaatttaaaaaaaatattttcagccaaag

SEQ ID NO: 12043 - DNA, 470 bp, Homo sapiens
tcaccccaaagaactttaaattctgctttcatgccagatttcccagcagcgactgccaaacagctgcagagggagcctgaaacagagaaggggctcctctggccccccagaagctaggctgatttcggaatgcctctagaatccagcgtgcttgcccatcactcataaactgtgagtgtaaaccgcagttaagctcatatgcttcagttcctaaattacagttgcacttgggggaaatagctgctggtatttatcacagtgccctccccctagaaagtggcccacacagtcagttattacttggtcctgctcctcaacccggagcagcctgggttatcacttggccaagcagttattacgtggccagccttcctgatgcacctgcgtcagcaacctgcaaaggagccacctgctgtgccctggttatggaggaagcagagtccagtgtcccttctcaccagcacagcctg

SEQ ID NO: 12044 - DNA, 479 bp, Homo sapiens
ggtcacagcactcgagaacctcatcccactaaaaacaactattaaatacggcagctggaagaagacctgacgcttgctggtggaagtggccccagaaggctgcagctatgagcgattgtgacgaggtggaaggagggttccctggaattggaggggacgttgtgacccaagcatggatggtgtgggtagcaggatgtgaactgaggggctgataggtgtttgtggtgtgtgtgtggctggggttggccgggtgctgctttccacattgacttggcgcctgccagcggtgcggtccagttctttgactgaagttctcgccagtcatggacttcctatcctcctgtttcacgagctccatctccatcttctgctgatgtgtgagagctgccggcacggccagcagtggcaacagtaacgccttggagtgcagtccctcgccgggtggagcagtgtctggaacggcgctcagccgctcgcag

SEQ ID NO: 12045 - DNA, 1935 bp, Homo sapiens
tcatgggaggatgcaactttaaggggtttgttcctcctttgtgataagagttttcacagtgcttccgtatacatttctcatctcatccttataatagctctgttattcccattttgcagatgaggaaacagtctcagagaagataagagactttcttagagtcacacagctcatagatgggcagactgtggtcttctgcctcctagttcacaatactacactttctttctgtgatacaagctcacagacatttgtttaaaatgactactggttacagatgctgtggtgatttctggagaaatatcatcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtactttttta

SEQ ID NO: 12046 - DNA, 4639 bp, Homo sapiens
tcatgggaggatgcaactttaaggggtttgttcctcctttgtgataagagttttcacagtgcttccgtatacatttctcatctcatccttataatagctctgttattcccattttgcagatgaggaaacagtctcagagaagataagagactttcttagagtcacacagctcatagatgggcagactgtggtcttctgcctcctagttcacaatactacactttctttctgtgatacaagctcacagacatttgtttaaaatgactactggttacagatgctgtggtgatttctggagaaatatcatcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaaaagctgcacatttacagtgacttaagacctggtcttctttctctgttggatcatggccggtgaaacagttttgtcttgcagtggaaagagacttcctgtgaatgtttctcaactggtttctgctgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtgacactgaagatttaaacacaagcattcataagatgcgctgatctctggtggttgtcactagttctgctaggtgataatgatttacccatagatggagctgttggatattattttattgtacaaattcatgtttaaaaaactttgtgactgtttctagttaagtaattttttaacctttcttgggtcatagacttctttggtaaactatgaactctcaccaaaaagatacacatgcaacatgttaaatacatgttagactttgcatacaattttaggggctcatgggcctctaagcctatccatgtattccaggttaagccctctgttatgatcaatccattacttacagattaagtttttataaaataaagtatcttttaaatattcatggatcaagtaacaagagcaaacttgaataaagttatgttctacatattttggcagcatagcatacctgtgtcccttgagaatttagccttcatatgtttctgcaattggaatggcaaataaaagtgctatcatctacatttttttaaagaattacaaatattaagaaattatcaagtgaaatttaaaatttttcttttaaaggtgttaattccaaatagagcatgcattcatttatttattcaacaaatattaattgagcatcttctgtatgacaagtagtattctgtgcactggggataccatagtgaacaaacaggaaatcctatccttatgaagtttataaacagggcttcctgctcatgaaatggatacaaggaatgaagacaggagaaaataagaacaatacttaggtttttttataaagtggatagatgatgatgccatatatggattttcagacatccctttactgaaagtcttagcattatatctattagtattccacatttaagtacataatttaaaagtaatttaaagtcatctctttgaaggatattaacaaattacaatgcaaatgctacagaatttttagaatcctaacaactattaggcagtgataagaaaaatccatttggcttaaagtaaactttaataagtgcctagtattgcagatgcagtttatggtgaacttagaggattaaaaaccaaagggggcttcattgagatattcacatgccataaactctcccatttaaagtataccgtttaatggttttagtatatccacagagttgggcaagccattaccacaatcaatttgagaacattttcattaatcacaaaagaaatcctgaaatgaaaccaccaccaccatcgctccagccctgggtggccactcctctactttctgcctcttatggatgtgccataagaaatgtggacatttcatataaatgagattatataatatgtggtcttttgtgacttctttcacttagcgtattttcaaggttcatccgtgttgtagaatgtgtcagtactacatttctttttatggccattccattgtgtgaaatatatcacattttgtttacccgtttatcagctgatggat

SEQ ID NO: 12047 - DNA, 4965 bp, Homo sapiens
tcatgggaggatgcaactttaaggggtttgttcctcctttgtgataagagttttcacagtgcttccgtatacatttctcatctcatccttataatagctctgttattcccattttgcagatgaggaaacagtctcagagaagataagagactttcttagagtcacacagctcatagatgggcagactgtggtcttctgcctcctagttcacaatactacactttctttctgtgatacaagctcacagacatttgtttaaaatgactactggttacagatgctgtggtgatttctggagaaatatcatcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaaaagctgcacatttacagtgacttaagacctggtcttctttctctgttggatcatggccggtgaaacagttttgtcttgcagtggaaagagacttcctgtgaatgtttctcaactggtttctgctgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtgacactgaagatttaaacacaagcattcataagatgcgctgatctctggtggttgtcactagttctgctaggtgataatgatttacccatagatggagctgttggatattattttattgtacaaattcatgtttaaaaaactttgtgactgtttctagttaagtaattttttaacctttcttgggtcatagacttctttggtaaactatgaactctcaccaaaaagatacacatgcaacatgttaaatacatgttagactttgcatacaattttaggggctcatgggcctctaagcctatccatgtattccaggttaagccctctgttatgatcaatccattacttacagattaagtttttataaaataaagtatcttttaaatattcatggatcaagtaacaagagcaaacttgaataaagttatgttctacatattttggcagcatagcatacctgtgtcccttgagaatttagccttcatatgtttctgcaattggaatggcaaataaaagtgctatcatctacatttttttaaagaattacaaatattaagaaattatcaagtgaaatttaaaatttttcttttaaaggtgttaattccaaatagagcatgcattcatttatttattcaacaaatattaattgagcatcttctgtatgacaagtagtattctgtgcactggggataccatagtgaacaaacaggaaatcctatccttatgaagtttataaacagggcttcctgctcatgaaatggatacaaggaatgaagacaggagaaaataagaacaatacttaggtttttttataaagtggatagatgatgatgccatatatggattttcagacatccctttactgaaagtcttagcattatatctattagtattccacatttaagtacataatttaaaagtaatttaaagtcatctctttgaaggatattaacaaattacaatgcaaatgctacagaatttttagaatcctaacaactattaggcagtgataagaaaaatccatttggcttaaagtaaactttaataagtgcctagtattgcagatgcagtttatggtgaacttagaggattaaaaaccaaagggggcttcattgagatattcacatgccataaactctcccatttaaagtataccgtttaatggttttagtatatccacagagttgggcaagccattaccacaatcaatttgagaacattttcattaatcacaaaagaaatcctgaaatgaaaccaccaccaccatcgctccagccctgggtggccactcctctactttctgcctcttatggatgtgccataagaaatgtggacatttcatataaatgagattatataaaaaaaaacaaaaaaaacacaaaaaaaaaaaaaagggggggggggaaaaaagatatccgaggggggcaattaaggggataaacaagttttttgtgtaaaagggggccaagaggggggaaaataagccgcacgcccagggcggaccggaaacacgcgcgtacaggcgaaccaccgaacactgagaactcgggcaaacgaccaccacgcgcgggcgcacacactgggaacaccccacagaagaagaccgaggaaataaactcaggcgacgcgtgacaccacgcaatggtcggccgaaatgcgcgatgattaataaaaaagagcaaaaagacagaacacaggcccgacagagacgacgaccgggcaagacaacgcaggagaacagagaccagaaccaagcgagagtcaacaaccacatacacgacccacgacaaacagaaagaagacacagccacacagacgagagcaccacaagga

SEQ ID NO: 12048 - DNA, 4712 bp, Homo sapiens
tcatgggaggatgcaactttaaggggtttgttcctcctttgtgataagagttttcacagtgcttccgtatacatttctcatctcatccttataatagctctgttattcccattttgcagatgaggaaacagtctcagagaagataagagactttcttagagtcacacagctcatagatgggcagactgtggtcttctgcctcctagttcacaatactacactttctttctgtgatacaagctcacagacatttgtttaaaatgactactggttacagatgctgtggtgatttctggagaaatatcatcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggtcaagactaaagaattactgagtccaggctaccccttagaagttgtattttatctccctctctccttgcaaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaaaagctgcacatttacagtgacttaagacctggtcttctttctctgttggatcatggccggtgaaacagttttgtcttgcagtggaaagagacttcctgtgaatgtttctcaactggtttctgctgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtgacactgaagatttaaacacaagcattcataagatgcgctgatctctggtggttgtcactagttctgctaggtgataatgatttacccatagatggagctgttggatattattttattgtacaaattcatgtttaaaaaactttgtgactgtttctagttaagtaattttttaacctttcttgggtcatagacttctttggtaaactatgaactctcaccaaaaagatacacatgcaacatgttaaatacatgttagactttgcatacaattttaggggctcatgggcctctaagcctatccatgtattccaggttaagccctctgttatgatcaatccattacttacagattaagtttttataaaataaagtatcttttaaatattcatggatcaagtaacaagagcaaacttgaataaagttatgttctacatattttggcagcatagcatacctgtgtcccttgagaatttagccttcatatgtttctgcaattggaatggcaaataaaagtgctatcatctacatttttttaaagaattacaaatattaagaaattatcaagtgaaatttaaaatttttcttttaaaggtgttaattccaaatagagcatgcattcatttatttattcaacaaatattaattgagcatcttctgtatgacaagtagtattctgtgcactggggataccatagtgaacaaacaggaaatcctatccttatgaagtttataaacagggcttcctgctcatgaaatggatacaaggaatgaagacaggagaaaataagaacaatacttaggtttttttataaagtggatagatgatgatgccatatatggattttcagacatccctttactgaaagtcttagcattatatctattagtattccacatttaagtacataatttaaaagtaatttaaagtcatctctttgaaggatattaacaaattacaatgcaaatgctacagaatttttagaatcctaacaactattaggcagtgataagaaaaatccatttggcttaaagtaaactttaataagtgcctagtattgcagatgcagtttatggtgaacttagaggattaaaaaccaaagggggcttcattgagatattcacatgccataaactctcccatttaaagtataccgtttaatggttttagtatatccacagagttgggcaagccattaccacaatcaatttgagaacattttcattaatcacaaaagaaatcctgaaatgaaaccaccaccaccatcgctccagccctgggtggccactcctctactttctgcctcttatggatgtgccataagaaatgtggacatttcatataaatgagattatataatatgtggtcttttgtgacttctttcacttagcgtattttcaaggttcatccgtgttgtagaatgtgtcagtactacatttctttttatggccattccattgtgtgaaatatatcacattttgtttacccgtttatcagctgatggat

SEQ ID NO: 12049 - DNA, 4138 bp, Homo sapiens
tcatgggaggatgcaactttaaggggtttgttcctcctttgtgataagagttttcacagtgcttccgtatacatttctcatctcatccttataatagctctgttattcccattttgcagatgaggaaacagtctcagagaagataagagactttcttagagtcacacagctcatagatgggcagactgtggtcttctgcctcctagttcacaatactacactttctttctgtgatacaagctcacagacatttgtttaaaatgactactggttacagatgctgtggtgatttctggagaaatatcatcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaaaagctgcacatttacagtgacttaagacctggtcttctttctctgttggatcatggccggtgaaacagttttgtcttgcagtggaaagagacttcctgtgaatgtttctcaactggtttctgctgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtgacactgaagatttaaacacaagcattcataagatgcgctgatctctggtggttgtcactagttctgctaggtgataatgatttacccatagatggagctgttggatattattttattgtacaaattcatgtttaaaaaactttgtgactgtttctagttaagtaattttttaacctttcttgggtcatagacttctttggtaaactatgaactctcaccaaaaagatacacatgcaacatgttaaatacatgttagactttgcatacaattttaggggctcatgggcctctaagcctatccatgtattccaggttaagccctctgttatgatcaatccattacttacagattaagtttttataaaataaagtatcttttaaatattcatggatcaagtaacaagagcaaacttgaataaagttatgttctacatattttggcagcatagcatacctgtgtcccttgagaatttagccttcatatgtttctgcaattggaatggcaaataaaagtgctatcatctacatttttttaaagaattacaaatattaagaaattatcaagtgaaatttaaaatttttcttttaaaggtgttaattccaaatagagcatgcattcatttatttattcaacaaatattaattgagcatcttctgtatgacaagtagtattctgtgcactggggataccatagtgaacaaacaggaaatcctatccttatgaagtttataaacagggcttcctgctcatgaaatggatacaaggaatgaagacaggagaaaataagaacaatacttaggtttttttataaagtggatagatgatgatgccatatatggattttcagacatccctttactgaaagtcttagcattatatctattagtattccacatttaagtacataatttaaaagtaatttaaagtcatctctttgaaggatattaacaaattacaatgcaaatgctacagaatttttagaatcctaacaactattaggcagtgataagaaaaatccatttggcttaaagtaaactttaataagtgcctagtattgcagatgcagtttatggtgaacttagaggattaaaaaccaaagggggcttcattgagatattcacatgccataaactctcccatttaaagtataccgtttaatggttttagtatatccacagagttgggcaagccattaccacaatcaatttgagaacattttcattaatcacaaaagaaatcctgaaatgaaaccaccaccaccatcgctccagccctgggtggccactcctctactttctgcctcttatggatgtgccataagaaatgtggacatttcatataaatgagattatataatatgtggtcttttgtgacttctttcacttagcgtattttcaaggttcatccgtgttgtagaatgtgtcagtactacatttctttttatggccattccattgtgtgaaatatatcacattttgtttacccgtttatcagctgatggat

SEQ ID NO: 12050 - DNA, 2977 bp, Homo sapiens
tcatgggaggatgcaactttaaggggtttgttcctcctttgtgataagagttttcacagtgcttccgtatacatttctcatctcatccttataatagctctgttattcccattttgcagatgaggaaacagtctcagagaagataagagactttcttagagtcacacagctcatagatgggcagactgtggtcttctgcctcctagttcacaatactacactttctttctgtgatacaagctcacagacatttgtttaaaatgactactggttacagatgctgtggtgatttctggagaaatatcatcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaaaagctgcacatttacagtgacttaagacctggtcttctttctctgttggatcatggccggtgaaacagttttgtcttgcagtggaaagagacttcctgtgaatgtttctcaactggtttctgctgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactga

SEQ ID NO: 12051 - DNA, 393 bp, Homo sapiens
aagaattactgagtccaggctaccccttagaagttgtattttatctccctctctccttgcaaggtatcaggttgttttcttgacatttgtcattctttgctaaacagatatatagcttggaaggtatcagaatagcacattttagttaattgagaatttggatttattgaaatgtgagtagactaggatttaccatcaattcattatggtaaactttctctttgccatgatcccaaactatgggagaatgcaaattgacaatgttaaaccaattaaggtagaattaaatatagaggaagtgcttaaaggcaagtagaaatggccattgaattattaaaataatttgtttccctttgtaaaaacaaatgtaaatgaagtaaatatttcctgaca

SEQ ID NO: 12052 - DNA, 2447 bp, Homo sapiens
aagcttgttaattttaataacaaatctttatgaatctgaagagaattgatgttcatgataatgatatagatgtttaatatactttctgaaataacactgtttactgttcaagttatattgactataatttacattattcttgtttgagaattgtatggcatagacactcattagtcagagtgtctagacatccagaccatgcctgataacacaagaatcatatatcattctctagaaaacaggctgtttggttatagagtatttatcttaaatatattaacagacactacataaacattgaaaagccatgcaagttatagctcacaggagccagatctactgcaactggggcctacatacaaaattttatggcagtggtttcagtatgacaatcttttgaattgatgccgtatggtaaaactataaagattttttaaaagctctgtctcagctagaatttttaagattataactgaacagtatagcccttttagttgtttgaaaattacataatgattcaaaagcttgtttcactgcctttcccagcactaagaaaattaacaatcatttcttttaatttccttgaatcagagccattctaaagtgactctggaccagcaattctgagctatgatttcatgatacatgtattaatatctaaatgagttgtgagttgacataagaaccatagttccataataattatcttcaaatcaatggatatcttaaatgtgtttttttcttccttagagattattattaaactgatgtatttgataataaagaattttaggactgagaaagttaagtttttcttaccaataataagatattgaaatatataaattataaaacagaaataaaatgaaataaaggaggttatccctaaagtcatttaccttagtcacttgcaattaaatatggttacttcggaagaagaagtgtggccctaaagctactgtaacatgaatcatgccctaatgtgcactatatatgaactactttggtcagaaggcagcggcgggtaaggatggcttcctctcacagtgcttcttaggctatccatttaccaaggaattctaatctctttctctcacttcaccaggaaaggagggagtttaagatatagaactgggcatgctagcctcttttttcccttttgtggatttgtcataactgcagagaaccgatgttgtggtctcttgccagctacattgtgaaccttgcagtgaaagttctttgcctctgcaaagggagatttgtgcttgtgcagaactgcccatgccttagtaagcaggtctgtctaattctaagttcaatatctggtggctattgttggcataaacttaaagtacatcctctaacctagcctttttcagcagtaaacttaaaatattgaatctccatctgtctgtgtctcaagtggttcagaggtcaggagaggagagggacattattttatgactccctcaaactttaacaaagactagtgcagattatatttcgaagtaagcatgagatatattaaaaaccacatgtgggaattctttcctaattttagaggttttttttaaataatggaaattctattgaaattgagtagtgttaattacaaggcaacaggtaaacatttgttcaggatatttaaaaggtctgctgagttggaattgtgacagaccacattgttgactctagattgaattggaagggaagaatgtgaaatgaattaggatatcctctgttcacctctattaactttcttaaatgagtataacttagaaataataaaatgcaagtattttaacgttatagttgggagagttttgacaaatgtaaacacccacttcaccaccactaccatcctgatatagtgtgtgtccatcacccaaaaagttctctaaagcccttttgcagttggttcccctccacctgaacagccatccctagtcaactacttttctgctttctgtggctatacgttagatttgacttcagaattctagagtttgaaataaataggccatataatatgcactctttttgtgtctgactttttttttgcttaacatgatgcttttgaaacccatccatgttgagattcatccatgttatcatgtgtatcaataataagttcctttttattgctgaatagtattctagtatatagatataccacaatttgtttagctgttcacctattgatggacatttaggttgtttcaagttttgatctattatgaataaagctgctatatatataaatcacaattctatgtgtggacatatgtgttcatttctcttatgtaaatacctagggatggaattgctgagtcttatgaccagtttatgcacaactttaaaggaaactgccaaacttttccaaattatctgtaccatttgggatttctgctagcaatgtattaaattaatttcagtttctccatatc

SEQ ID NO: 12053 - DNA, 2264 bp, Homo sapiens
aagcttgttaattttaataacaaatctttatgaatctgaagagaattgatgttcatgataatgatatagatgtttaatatactttctgaaataacactgtttactgttcaagttatattgactataatttacattattcttgtttgagaattgtatggcatagacactcattagtcagagtgtctagacatccagaccatgcctgataacacaagaatcatatatcattctctagaaaacaggctgtttggttatagagtatttatcttaaatatattaacagacactacataaacattgaaaagccatgcaagttatagctcacaggagccagatctactgcaactggggcctacatacaaaattttatggcagtggtttcagtatgacaatcttttgaattgatgccgtatggtaaaactataaagattttttaaaagctctgtctcagctagaatttttaagattataactgaacagtatagcccttttagttgtttgaaaattacataatgattcaaaagcttgtttcactgcctttcccagcactaagaaaattaacaatcatttcttttaatttccttgaatcagagccattctaaagtgactctggaccagcaattctgagctatgatttcatgatacatgtattaatatctaaatgagttgtgagttgacataagaaccatagttccataataattatcttcaaatcaatggatatcttaaatgtgtttttttcttccttagagattattattaaactgatgtatttgataataaagaattttaggactgagaaagttaagtttttcttaccaataataagatattgaaatatataaattataaaacagaaataaaatgaaataaaggaggttatccctaaagtcatttaccttagtcacttgcaattaaatatggttacttcggaagaagaagtgtggccctaaagctactgtaacatgaatcatgccctaatgtgcactatatatgaactactttggtcagaaggcagcggcgggtaaggatggcttcctctcacagtgcttcttaggctatccatttaccaaggaattctaatctctttctctcacttcaccaggaaaggagggagtttaagatatagaactgggcatgctagcctcttttttcccttttgtggatttgtcataactgcagagaaccgatgttgtggtctcttgccagctacattgtgaaccttgcagtgaaagttctttgcctctgcaaagggagatttgtgcttgtgcagaactgcccatgccttagtaagcaggtctgtctaattctaagttcaatatctggtggctattgttggcataaacttaaagtacatcctctaacctagcctttttcagcagtaaacttaaaatattgaatctccatctgtctgtgtctcaagtggttcagaggtcaggagaggagagggacattattttatgactccctcaaactttaacaaagactagtgcagattatatttcgaagtaagcatgagatatattaaaaaccacatgtgggaattctttcctaattttagaggttttttttaaataatggaaattctattgaaattgagtagtgttaattacaaggcaacaggtaaacatttgttcaggatatttaaaaggtctgctgagttggaattgtgacagaccacattgttgactctagattgaattggaagggaagaatgtgaaatgaattaggatatcctctgttcacctctattaactttcttaaatgagtataacttagaaataataaaatgcaagtattttaacgttatagttgggagagttttgacaaatgtaaacacccacttcaccaccactaccatcctgatatagtgtgtgtccatcacccaaaaagttctctaaagcccttttgcagttggttcccctccacctgaacagccatccctagtcaactacttttctgctttctgtggctatacgttagatttgacttcagaattctagagtttgaaataaataggccatataatatgcactctttttgtgtctgactttttttttgcttaacatgatgcttttgaaacccatccatgttgagattcatccatgttatcatgtgtatcaataataagttcctttttattgctgaatagtattctagtatatagatataccacaatttgtttagctgttcacctattgatggacatttaggttgtttcaagttttgatctattatgaataaagctgctatatatataaatc

SEQ ID NO: 12054 - DNA, 343 bp, Homo sapiens
caagaagaaatagcagcccaattcaaatcctgcccctgacctcctgcccctaaaacataggcattcctagtcttctgaataatggaagacatagagaaagaatgagatggtcaaaaatatatcttcctaaatttggggcacaactgcactcatcagggatgatttgaactggaggtaagggggatctgtgaaagacaagagaaggcccggagttttagggtgggccatgtggaggctctttcaagggagaactcgggggggttcctgaaaaggaagagaacctcatcccacccagatatcttgcttgatgagtatccagatgtactggagttgagagatagag

SEQ ID NO: 12055 - DNA, 1593 bp, Homo sapiens
actccctttcttgatcttaatcctcaagaaaggatgaaaagataagcagtgtatttaaactgatcattcctgcaaagagctttttctttctcaaataagaacctgttaacctctaaatccacttatcttcaatagcgccttagggaggtgatggagagagttctggctggggcaccttccttgctccccctgagtagcactaagtaatctcacaggacaggcaaggcctttctgaagaggtcttagagtgcagggaattgcatgacaggtgctgttagccaccttggaagaactgcaggccttgcgtggtgccaccttgtttgcgggaagcccagccctgtccattcccctggccctagcatctgtttatctaatagcagtaccaatttttattgttaggataagttgtaggagaaattagcaaaggttaactgactgctgtgggtagacagtacaattcttcttcagtttctgacttaggagtgtttccgaaaagttaagtgaaaacaaaagtttgaagtgtttcccttttagttacataacagacactcattacggaattgaacagttttagacccataaataattaagttaaaagcataacaaaatcctgttaggaaactgatgaaaaatttgtttctaaaacactttagattttaaacttgaacacgtagtgaaatgtcttttaaaacaatgaagatgggtgcagtgttcacaggcctctccactaagcagatgtctactgagaacacagtattaggggatgtgggtggtagaaagatgcagtggccaagcctcaccctgggcgagctggggcaggctcgctctctcaggcacagtgaggaaggcacactgaagggggttgccctgactgccagcatgccaggtatacatggtgactgaagctgccacaggtcttctattgaccacactacaaggactcttcttggtcactgatgacagctgttgtctgtctgccattggccacactatccagttctcactggccaagcaggtgggcggggcccagccaggacttgagaatcccactgggaaaggacagagcctgggttcaggctaggtccctcttctgggcctgggcagcttccagatgtgaaggatatgagtctctcccgctctcaggaatcattctctcatctcatttggatggctatctcctattttaaatttgaatcatggaatttgaatttgtaatttggttttagccttagtttccttctggttcgcacctaagcaagataattttaagacacttaggtcaataactgtgcctataagaatttcctttgggccaggcatggtggctcacgcctgtaatcccagcactttgggaggccaaggcgggcagatcacctgaggtcacaagttcgagaccagcctggccaacgtggcaaaaccctgtctctactaaaaatacaaaaattagccggggtggtggtacatgcctgtagtcccagctactcaggaagctaaggcacgagaatcatttgaacactggaggcagaagttgcagtgagctgagatcgtgccactgcactccagcctgggtgacagagtgagactctgtcttgg

SEQ ID NO: 12056 - DNA, 1059 bp, Homo sapiens
agtgccttttagatgacagggctcctggtgtcagtcttacaagcatttgtgaagtgctaagaaagtcaagcgattttttttttttacattaagttagctatgagtggcaagagttacatggttgctccagatggttagtgtctaaaatggccaagagcagagaagtgctttactttacgtgctgaaactttattttagtaaattctactctagttttaccatctggagcaacacgatgtatactctttcattcacacagcagcattttttcattttttaaaaatgtgtaatactaaatacatgcttgtttttacacttctggaaaaaagagcagggggagcttcaaagattttcagaagtaacacgagttagctaatatcctgctcctaagcctgggcaacatggtgagaccctgtccctacaaaaaataaaataataataataataatatcctgttcctagatcttttctcacttgatatactttgagtatccttccatatcattacaaaaaaaaatcgatctcatttcttttacagctacatcagtttcatgtatggttgtactataattttcttaacctatttctcattgatgaatatttgggtaagcttcaatggcttattatactaagcaatgtgtctcagtacatttttgttggataaaattctttgaagtgtaactaatgggtcaaaatgtatgtacacatttagtcattagtagacataaccaaactaatcctccaaaacaaaatacagcttttaagtgctcctctttgccaatccaagaagaaacaaacaaaaaagggtctagttgatttttaactttgcattcccttaataaaaggaccatttgttttgctttcatctgtgaattacatattcatgttttctgccatctttttctattgtgctgttgatctatttctattacacttgtcttataaatttgtcttaaaaataatgatgaggataatttactacatcttataaataacactctaaaacccattagttatcaaatactaaagacaaatcactttatctaccagttagttgtg

SEQ ID NO: 12057 - DNA, 375 bp, Homo sapiens
agtaggcacgtggtctacagtctcagctgaaatcagcctttgagtcatcgcagcccagacatcagatacaggagtaaagaaaattccagatgattattacccccagccgcttgagttttctcagtgagacctcagacatcgcagagcaaagacaagccatccctgctgttatctaaattcctgcccacggcatcttcgaacatagtcaaatgattgctgctttaggccactaagtctgagctggtttattgcattcggcaactagaacaacatttttactaacatagtgattgaatgtagacttaataatgaaagagtccaacttccataagaaaaaaattcataattttaaaggaagaggctttgctgttaaag

SEQ ID NO: 12058 - DNA, 232 bp, Homo sapiens
gtccccaggaccagcgactctgtggctcactcggccactgggtctcggcgcaaaccctccctaggcagtgcgggcgatgctgactgcagacgtcgggcagggctttcgtgcgggcgggagcgggggaagccagtgcgcccgggcgtcagctagttgatgcgggaagaggctggggagctgcagggccgtccgcccccgggtgcggtgctctggcgcagggcctgggctgagc

SEQ ID NO: 12059 - DNA, 139 bp, Homo sapiens
aattcaagaaacttgttgccaggagacctgtcttgcaagaaatgttaaatgaaattctttagggaaacaaaagatatgtaactgaaacctggatcaacatttttttaaaaagagcattaaagaaagaattgttttacat

SEQ ID NO: 12060 - DNA, 540 bp, Homo sapiens
gtaaaaagctggaagatgaccctaaattcttgaagtctggtgatgctgccatcgttgatatggttcttggcgagcacatgtgtgttgagagcttctcagactatccacctcggggtcgctttgctgttcgtgatatgagacagacagttgcggtgtggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaa

SEQ ID NO: 12061 - DNA, 5575 bp, Homo sapiens
ctcggaaaagcttttcagtaaatgcactcatgctgctccaggagctcttctctgcaacaagccacccatctgccatcaacaagttaagaccaagagaactaacggctgcggaaatgagactgaagctttgattaaccagctgagcagttagaggtggagaaatttaataacttatattcaaaactgatttagggatcagagcaatcacagaaaatgaaaccaatgctttccagagggatatcctaaggaaaaaacaactcgtcctggtggattcaattttacttggaaagcctgggacacagaaaacaggaaactggtcaaaggctcctacatgttagagccttttacagactcactgcgttgagtctaacaaccgcgactgaatgcagcctccaatgtgctcagaagaatgggcttacatttcaagtggccattaggggcccctatgctggcagcaatatatgcaatgagtatggttttaaaaatgctgcctgccctgggtatggcgtgtccacccaaatgccgctgcgagaagctgctcttctactgcgactctcagggcttccactcagtgccaaacgccacagacaagggctctctgggcctgtccctgaggcacaatcacatcacagagctcgaaagagatcaatttgccagcttcagtcaacttacttggctccacttagatcacaatcaaatttcaacagtaaaagaagatgcttttcaaggactatataaacttaaggaattaatcttaagttccaacaaaatattttacttgccaaacacaacttttacccaactgattaacctgcaaaatttggacctgtcttttaatcagctgtcatctctgcacccagagctcttctatggccttcggaagctgcagaccttgcatttacgttccaactccctgcggactatcccagtacgcctgttctgggactgtcgtagtctggagtttctggatttgagcacaaatcgtttgcgaagtttggctcgcaatggatttgcaggattaattaaactgagagagcttcacctagagcacaaccagctgacgaagattaattttgctcatttcctacggctaagcagtctgcacacgctcttcttacaatggaacaaaatcagcaacttgacatgtgggatggagtggacctggggcactttagaaaagctagacctgactggaaatgaaatcaaagccatcgacttgacagtgtttgaaacgatgcccaatcttaaaatactactcatggataacaacaagttaaacagccttgattccaagatcttaaactccctgagatccctcacaaccgttggtctctctggcaatctgtgggaatgcagcgcccgaatatgtgctctggcctcctggctgggcagtttccaaggtcggtgggaacactccatcctatgccacagtcctgaccacacccaaggagaggatattctagatgcagtccatggatttcagctctgctggaatttgtcaaccactgtcactgtcatggctacaacttatagagatccaaccactgaatatacaaaaagaataagctcatcaagttaccatgtgggagacaaagaaatcccaactactgcaggcatagcagttactaccgaggaacactttcctgaaccagacaatgccatcttcactcagcgggtaattacgggaacaatggctttattgttttctttcttttttattatttttatagtgttcatctccaggaagtgctgccctcccactttaagaagaattaggcagtgctcaatggttcagaaccacaggcagctccgatcccaaacacgactccatatgtcaaacatgtcagaccaaggaccgtataatgaatatgaacccacccatgaaggacccttcatcatcattaatggttatggacagtgcaagtgtcagcagctgccatacaaagaatgtgaagtataatatctacccatcatcaaaaatcacatcagataagtaacctattttacatagtagaggctaaatacatatctaatttttaccaatggtgacattaagcctaattttccaaactaagtggagacttagtttttgaagtgttgaagtatttttaattttttaaatgaaaccatattttaagtgttaaatgaatcaatgctcacattaatttgcactcctgttggaaagtctaaaatgcttacttcaaaataagaaatgtacgtaattatatacaatcgtgtgtaaacctttacactaaggtctccatatactatttttttctactgaaaacaatttagaaagaagctattgggcagaaacagatatagatcaatacctgtttgatcactgctctccatcccatgtaccacaactatcttgctgcttaaaaggagacttagtaaagttctcttgtatgataatttggtatttactcaaatcttcaatttcttgccagggtgggaagtagaatttcatgtatgctgaagactggtaaatattaaacattctccttccagagtttctgcctgggttagtagatattatcaaagtccatatcatgaattcagaaccctttaatgtaattctaataagctgagtgactctttaatatatttacacaatgaatccaagtgactgtgaaaaggtctcattacaatgaaaccaatcctaaataattacaccaacttcttatacatttctcgtttgacttataatggacatgatttttgtggcatttagacaactgttttaaactagcattaaactgtcattgtactaattaatgtactaaatcctatgtttacattaatatgtgaaaaaagatttagaagatattttggagataaacaagacaaactgagtcaatttaacaatcctgacatgctccctccaatttaaaagcacacacacacacacacacacacacacacacactctcgcgctctctctctcaactatcatgatcaaagatgccttgacaaaggggtttaaacctctttcttctgctttttcctgatcttcaaacctcaaagagccaagttaaaaataattggctagcaacaggcttaacactgattcttattgtattacaaaggaaccatgaaaaaaaacactttctaactattatataatacatttcgatctttcaataaagatacgcattcacgctgtaagtgtagttcagtgtaggtgaagaaaacagcaccactgagatgaatctcatggcagaacaactcgacatgcctatgcagccacacagtggtaacttgaaggcagcacagaggtgagggattaaaaggaaaggcagattttgaaatctgactctcaggttagctggagttacaaggcagccaacaatgattatacacaatctgcaccaaacagggaaaggacctgctgctgaaaagggaagaggggtagatcctccaatgtaaatataaacatgccatagttaacaaatgataaggatgccacatttttcatgcagaaaagaaccacaggtattcagtttcttgtattatgatttctaaagaaaacctattaaatatttggaatttagatgcaagctactcattcacacagaacttttccataaacattgttccacatattgaaaaaactgtaaaattatagcactaacttgattttagaaaatgagcattttttacaactgccatttactgtatgtagaaaaaagacataaaaccttagagaaagccactaccatttttcaagttatcttttccccaacatcaacatcaacatgatatccttcattcagggcatattttttcttcccaggatcaaactgaaaacatgttaaggctatagtttagccagtaagatttaatcacaatttttcttctttaatactaagagatgggtaccttagtacccttcacctaacatctctcggtaaaaagcagacaagatcacaaattacagtaaaaatgtgctcttttttaaggtgggcagattagtttgtcaaagtctcagcccagttcaattcagttgatctcgagtggtgagtattttgtctcttgttaaaccagaccctgggcttgtctgggcagagacagaagctgatttaacagcatagagcacagcgccctacttccccacagacaggctgaattagaagcccctattacaaataagagcaccacgagctaaaatttaccaacccatttatcaggatgaccattgccatttgtcaggtgacagacagcttggtcacaacacaactgtgtcctgagcacacaagattccatcagccctgaaggacagcagaggagtattttccatcatttcaaaccacaaacaaaattaagatttaaactgtgggatgggtaagaaatccccttctttggctgggaatctccaccttaatccttaaaggaccataactggcaaaatccttagtgtacggacaaaagcaaattggaaaagccagccatttactaatttcagaggaacagcatagccaaggctagcgaggcatactttccagttgaaaaaaaatcaaaattttttgccttccatttttctgggtaatgtcctttaagaaaagtgaatgacagtagtaccaaaaaggtattttcctttctcatttaaaagcaaaaacctccctttttaattgcctgtagaaggcaagattttctttcatttttgtccatttgtgtttcagaatcagcacaggtttgaagattagactgttagtcatctgtgctttctttaccaactggctagaacggaacagcatcacagcaacgctgcggatcttggttacacagtgtcagagcttttgttttttgatggggttttatcctcttcaccaccactacccactccattttttttctatttttaagattagaggaaaatgaccattaagaaccagaaaaataattaatctctctggaaaaaggaaagctaaagaagactatgataccatacccatctagaaaccaagaactagtttgaaatcgtttatattcatttctgtagcatgacagggatttcaatcacctttctgaaaagagtgggctgataaacttgtaaatccacacacaactctgagaatacccactgccagcatcaaaaagcaaagatactaattttttaagccaaaaatctgtactaacacatgtaatttcttaatgtgcctaagttaatttctgtatcaattcaataaatggaattgactgaacttcccaacgccactaattattaaaatccatctgcttattctaatgctagtcaccaagagctagactccatctttccaataaaaatgagccctatgtagcactaggtttgaattctaaaattcaaaacaggcatttcattttcttaaggcacacttcctacacacagctatcaggggaaaaagctataaatgtcctgttctttttctgaagtgtggatatcaatataaaatttgttaaagaatatttttaacagctgacttacatgatcgttttcctaatacaggaatacagcgacagacctatctgaaaagtctgtttgggggcatacttttcatatcttattgactaaagcccttgagccaggaaa

SEQ ID NO: 12062 - DNA, 1780 bp, Homo sapiens
  misc_feature (3)..(3): n is a, c, g, or t
aantaccggggggggcgggctgcagctcgtgctgaattcggcacgagatttaatcacaatttttcttctttaatactaagagatgggtaccttagtacccttcacctaacatctctcggtaaaaagcagacaagatcacaaattacagtaaaaatgtgctcttttttaaggtgggcagattagtttgtcaaagtctcagcccagttcaattcagttgatctcgagtggtgagtattttgtctcttgttaaaccagaccctgggcttgtctgggcagagacagaagctgatttaacagcatagagcacagcgccctacttccccacagacaggctgaattagaagcccctattacaaataagagcaccacgagctaaaatttaccaacccatttatcaggatgaccattgccatttgtcaggtgacagacagcttggtcacaacacaactgtgtcctgagcacacaagattccatcagccctgaaggacagcagaggagtattttccatcatttcaaaccacaaacaaaattaagatttaaactgtgggatgggtaagaaatccccttctttggctgggaatctccaccttaatccttaaaggaccataactggcaaaatccttagtgtacggacaaaagcaaattggaaaagccagccatttactaatttcagaggaacagcatagccaaggctagcgaggcatactttccagttgaaaaaaaatcaaaattttttgccttccatttttctgggtaatgtcctttaagaaaagtgaatgacagtagtaccaaaaaggtattttcctttctcatttaaaagcaaaaacctccctttttaattgcctgtagaaggcaagattttctttcatttttgtccatttgtgtttcagaatcagcacaggtttgaagattagactgttagtcatctgtgctttctttaccaactggctagaacggaacagcatcacagcaacgctgcggatcttggttacacagtgtcagagcttttgttttttgatggggttttatcctcttcaccaccactacccactccattttttttctatttttaagattagaggaaaatgaccattaagaaccagaaaaataattaatctctctggaaaaaggaaagctaaagaagactatgataccatacccatctagaaaccaagaactagtttgaaatcgtttatattcatttctgtagcatgacagggatttcaatcacctttctgaaaagagtgggctgataaacttgtaaatccacacacaactctgagaatacccactgccagcatcaaaaagcaaagatactaattttttaagccaaaaatctgtactaacacatgtaatttcttaatgtgcctaagttaatttctgtatcaattcaataaatggaattgactgaacttcccaacgccactaattattaaaatccatctgcttattctaatgctagtcaccaagagctagactccatctttccaataaaaatgagccctatgtagcactaggtttgaattctaaaattcaaaacaggcatttcattttcttaaggcacacttcctacacacagctatcaggggaaaaagctataaatgtcctgttctttttctgaagtgtggatatcaatataaaatttgttaaagaatatttttaacagctgacttacatgatcgttttcctaatacaggaatacagcgacagacctatctgaaaagtctgtttgggggcatacttttcatatcttattgactaaagcccttgagccaggaaa

SEQ ID NO: 12063 - DNA, 798 bp, Homo sapiens
cgtttctcggaaaagcttttcagtaaatgcactcatgctgctccaggagctcttctctgcaacaagccacccatctgccatcaacaagttaagaccaagagaactaacggctgcggaaatgagactgaagctttgattaaccagctgagcagttagaggtggagaaatttaataacttatattcaaaactgatttagggatcagagcaatcacagaaaatgaaaccaatgctttccagagggatatcctaaggaaaaaacaactcgtcctggtggattcaattttacttggaaagcctgggacacagaaaacaggaaactggtcaaaggctcctacatgttagagccttttacagactcactgcgttgagtctaacaaccgcgactgaatgcagcctccaatgtgctcagaagaatgggtaagtctgtgcatttatatgtcttgtacattcaacaaggaatcacgcttttaaaataagctaccgaattcacattttatgagggaaatcaccatcatattttggattttgaggtttaggtaaaagcatatatcgatgatgacagagacatgttttatcttctttttaaatggcttaagttttggtccagtcataccaataaggttaatttttctgcagtaaatgaaaaataagttatatgcagtgaaatcttttgctataatgttggtggtggttgttttttttaaatagcccatatgttctgctgaaaaatatcctatcttcttgttttccttaaattatattctgcaggcttacatttcaagtggccattaggggcc

SEQ ID NO: 12064 - DNA, 753 bp, Homo sapiens
atctcctcctagcttagggtcctgaagtcaggagttccttttttcttaaggattagggaccatgtttttcagggccttttgaagttgttaaagcattgtcaactggctcaactacacaaatgccatcatttattacccactgaccaaaagattaacttccaaatcctcatcctgacactaaaggcacctattatctagccaaaacttaccttcttcactgtgttaggatggtctcgatctcctgaccttttggtccacccacctcggcctcccaaagtgctgggattataggtgtgagccagtgcgcccggcctctcataattttcttaatttttctccatataccatctgaatactaatgtatttatttatttgtttatttctgaatgagactgatatccataaaaatgatctttccttgtatactctaactccctgctttctgggcgcttggcttctcaattaaaggctaatttaccagcttctcttgcatctgggtttgtccaaagtttggggccaatgagatgtgaacggaagttgcatgtattatttctagtttgtgccctaaaaaagaatatgtatgtgttacccttgccctcttaccctctccactggctggggtgcagatgtgatggcaggaattggggcaactactttggacccagaggcagaagccctgtgatgaggatggcagaactgctctattagccctggactgttacatgaaagataaataaacttgtatcttattca

SEQ ID NO: 12065 - DNA, 395 bp, Homo sapiens
gattcaatgcaatctcaatcaaaatcacagccagctttttaagaacagaaagtcacaagttgattctaaaatttacatgaaaatgcaaaggacctagtagacaagaatttttggaaaagaataacaaaatcaaagattttacactacctgaattcagaacttagtaaagcactggtaattatgagagtgtagtattggtgtaaaggcagataaatagatcagtggaacagaatgtagttcaaaatggaccaacacttacatagccagtttattttcaactaagccaccaaagcaattcaatggggaaaagaaagtcttttcaacagactgtgcttgaaaaactggttaactattagggacaaatatttatcttgatgcctgcctcacaacataca

SEQ ID NO: 12066 - DNA, 552 bp, Homo sapiens
ataattcatgaataatgttgtcaaaattacttttaatcacaagattaacctgcaacaactatgtatattatttttatgtgttggcttattatgttcaaaaactttgtttataaaaactgattttgctatttaatttttaatttactttagaaaataatgtagcacaatgttagatttattacatatgtaacaatactatttaatgctgcaaaatcatagcacatgtttgtaactatcacattttattaactgtctttgtacttttaaagaaagaaatatgatcataatctttagttttatttaaatcaaggatcatggatttattttgacatactttctaataattataattttttcctttgtaagcatatgtgcctaaattctcattgagggctttctgtactgtgtaaatagcacagaaaatgtctatataggaatgtttaaaaaatattttctgttgcatgtaactgaaaagatacatctaatatgcaattaaattgaataaaatagtacttagtgaattaaaaagttaagtattgaaaaacattgtca

SEQ ID NO: 12067 - DNA, 330 bp, Homo sapiens
tatgatccaccaaccaacttgttactaatgattagtggtgagctggtaacaagggataaatttttaattcaaagaggtttaacaacagttccatttaattttaaaaagtatgggtcttctcatgaaaatagtgacaaacaggaaagaaagctgtttttgttcaaaataagtattctcgtatttgtgaagtataatatgtacaaacaacccaaacattgtagctggcagtatgtatgttaatgtttttttgtttttgttttgtttttgtttttgagatggagttttgctcttgtcacccaggctggagtgcagtggcatgatctttgctca

SEQ ID NO: 12068 - DNA, 307 bp, Homo sapiens
tctaacttcttcgttgcgaagacagaaactggtcaatgaggtgaagtccattagtaaagcctcacaagacagtgacagcagtagcctagctctgaatccaaaagcctccttcttcccaggaaatgtcataatttttgtgcatggataatgtgaatcttgcaactaaccaaggttcttcttctgctccataaaaaaagtacagcacaatttcactaattatataagacttgtggccaagaaattcagataaaaattctcccctgctttgacttttggccagtttatctaaactagcatgggtttattc

SEQ ID NO: 12069 - DNA, 1032 bp, Homo sapiens
gaaactgacataagctgacactctgctgtatatcttggcacaatattgctttcatctctggagtcgggtgtcttacaaatttaacagtgtcagttgggaccgtccaaagatatttacagtaatgctgaggtcaagcaatggcagtggaactgtacaggatgtgggggctgggccaaagccgtgggactccggatttattttgtgagttggagaattgtctagtcatcagaccaacagaggagcaaacctctaacagcatctccctgcttcttcccaccctctcaacaggaggcattggagaaggtttatctaatgactgacatctgacgcataaggtgcaggcacacttactcagggtgcgaatatttactgagtgtctctgtggggccatacactactctaggcactggacatacaccagtaaagagaagctgtcctcatctgtcttattttctggtcttaaatctaaagccaagaggcatttagcagcacaaatcctcttcagcagtcaacactcccaaagtttcaggcactgaggaaaataaaaacaaaactgtggccctttcccaagaagcgcacagtgtccacaagaatgtgaaagccatctggaaactgataaactgcaaaaagctcagccatcttctgttggcaaaataaaagaatggatgtccttggaagaacgatgtccttggaaagtcatcaaataaaaatgtgagagaaacacagccattagaagctaaacagcttgggacacccttgtttacacagcacgatcactgtaatattttgaagtaaattgttgtttttaaaatccaataaaatctactttccattcaccttgaaaatgtgaattgaaactcaagagccaaaaacaaaaacaaaaacaaaaaacacatgagaacactacatgctgaccctgagtctccaaaacatctattttgtgcaaagcactttgcagtatccaagtacttcacattcattgcctcacggcatgaggaccccctcaaggcctttaaccatcaagatattgct

SEQ ID NO: 12070 - DNA, 592 bp, Homo sapiens
caggataaccaaagtgttgggtttaataagggttggggttctgccaggcaatggagaaggagataagaatattgacaataggtgcaaaagagtaattttagtgatggcccataaatcagtgctgaataacaaaggacaccatgacaggaaagaggtgacatcagtttgaattcctttaaaatggccattagtaaattggaaatccaggtgaggtccaagatgcagtggaatgagtattctagaaagatactaaagggtggtggtcagatttataattaagatttacaaaatagcactattattgccaacaacaagggtgaagagacttttgaaggaaaaatagtcaagggacttgagaggcagggttaggtggatgttgaaatcacaagaacgataagagaagttgtggaggaaagagagaccatgggccagatgttaagtcttcagtgaaggaaagtttggggtaggacacaccacagatattgataacaagaaggagtagaaagtagtataagatcaccccagctactactgaggctaaggcaggaagatctcaagtttgatcctggcttgggcaaaatagcaaggcacc

SEQ ID NO: 12071 - DNA, 550 bp, Homo sapiens
aatcagatgcctttaatcaacgggcttgcttcctcccactccccagacaacctgattcatgagatgcctgcctgttccccgtgggcatctgagtttgcagcccatgctcagtagagtttattcggcaatccttttcctgacctatagcagactcctagcccaccacatttctaatgcagctgttgcaagtcttgtccagacctttcagacccttgatctctccgggagattgtgcctcatacattattgaaaagattgaggccacacaacatgtgctctaatgcctcagctttctgcctttctgcttctaaggtctctgttctctctccattccgtcctccttccctcctttctgactctctttttctttttttcatcacttttaaaaattgtaaaatagaatgtacgtacagaaaaaggaggccgaggcaggagaatcgcttgaacctgggagacagaggttgcagtgaggcgagatcacgcattgcactccagcctgggcaataagagtgaaactctgtctcaacaaaaaagaaaaacaaaaaagaac

SEQ ID NO: 12072 - DNA, 312 bp, Homo sapiens
gaccatcaagatgctccagttcatcgggtattttctctgccccagccctggaatcaaccatttctccaggaggatcatgaaatttggatcaagatctttatatttactttcatattgaagaaactgtgtaaaacagagccaaaccctgtgaataaaattggtgaacatccctagcacaactgctttgaacttaaatagattccaagccccacattgattaggtcccagtgagtttcttctttagtgcaatcgatttttttcccaggtttatgagtcataataaataaaaaattgtatattttggagtatatg

SEQ ID NO: 12073 - DNA, 386 bp, Homo sapiens
gctgctttaatagcggcagctgcctgagtcaggctttctgtgttcccaggaaagggtgggagcgtttgcatcacaagttttagaaacgcacaggaagaggagatagccctcatcaaacgcggtttgccaaaaactgtaacttactctcaatagaaataatatgcattgaaattattatagtcaaatgtacacagccaacaagattcactttcataatgtattttatgaagtataagaaaagtcttgcatttctaaagtaatttggtatacttacgcttgaagtaaataattatacgtaacttcactggaaaaacagtttttaaagataaaaagtaagagctagttatccaaactgtctataggaacagaaacgttactaaaatgaa

SEQ ID NO: 12074 - DNA, 1647 bp, Homo sapiens
ttatcattctcctctttctgagaattaaggacttgccttgtgttttaatccccttcctggccccactccatgcacacggagccggggccgtcgtggctgctgagtggtctgtgcatggcttggctgtgttggtgctggcacagctgcgggtgatctcgtgctagggccctcaggctggcacctctgggcagtcttgtgaaggccgcactggtcatcgtcttcccccaagtggccgttgctcggccaaccagtaactactaaaagcctccccacccaggccctgggctgcgtctgttcagcctggagcaggctcaccctgcacctggggtctggagtgtgctgggggccgggctgtggggtgtgggtcgccaggctcgtggctgctctctggagacgggtcacacgcgttggcagacccctctccgggcctgtgggctgaatgctggcaggggtgctgggctccgtccgtccactgctgatgcgagctgggtgggcttcccttgccttcacccactcaggttggagtagggatggagtcgctgctcctgaggggttctcgggggccaggacgggacttttaattccctcttgagacatcttcggggcctgagtgtgcagggtctgagcccactctgtgatgagtatggggagcatgtggagccccagggcagctcagcgtgtggctcaaggccttctcctgtaggtttttaaatttatttgttcccttgccagaaatgagtatgacacccccaactggccacagttcctgccttaaaatgaccgaggttaaaatgagaaacacagagcttcccttggaggtcacggtacattccagtccaggagagacggagccggtgtctgacttgagtctgtggagggcagcagtgcacccgcccaatctgtgcattcccttctgagcttgatttagcccctctgtttcagtcagtcatgctcattgagaacagacagcaagtgtatgaagcgggtggaggctgattcagcccctgtattgaaaagtcggtcgtgctcattgagaacagacgggaagcgtacgaagcgggtggaaaatcccgcagtccagccattcccttcaaaacatgcctcccagccactcaggaggctgaggcaggaggatcacttgagcccaggaggtcaaggttgcagtgagccatggagtccattgcactccatccttggtgacagagtgagacatcgtttccaaaaaaattctacagaaatgctctatttacaaatttacataatttcctttggaaatagatttaaaaattttttaaggatgaggtaggtaggcaggaaaacggggttctttttggataaaaaaattcacatggccgggtgtcatggctcatgcctgtaatcccagcactttgggaggccgaggcaggcggatcacgaggtcaggagattgagaccatcctggctaacacggtgaaactccgtctctactaaaaatacaaaaaattagccaggcatggtggcgggcgcctgtagtcccagctactcgggaggctgaggcaggagaatggcgtgaacccgggaggtggagcttgcagtgagccaagatcgtgccactgcactccagcctgggcgacagagtgagactccgcctcaaaaaagaaaaaaaaa

SEQ ID NO: 12075 - DNA, 590 bp, Homo sapiens
tttctacttccagtcatgactcctgccctccttcactcctgccacctctgcataggagcctttcaggagtcctggcgccactccagcctccatttcagttgcccactcctccctcactaggtcaaacctgaccaggaaatacggagagaaaccctggcattgcagcaaaatatgctgtgtctgacctctcaggcctgccccctggtttctaagattggtgtttattttcatatcatgtaagcccaactcactggagccaaggtcattttccccacacaaaaataggagcttcagccctgagaagctactatcgtgcccaagaggtccaagccaaagttaagactgtgtcctcccagcactttgggaggccaaggcaggtggagcacgaggttaggagaccgataccatcctggctaacacagtgaaaccccgtctctattaaaaatacaaaaaaattagccaggcatggtggcatgtgcctgtaatcccagctacttgggaggctgacgcaggagaatcgcttgaacctgggagtcggaggttgcagtgagccgagatcacaccactgcactccaccatgggtgacagag

SEQ ID NO: 12076 - DNA, 1140 bp, Homo sapiens
agcagccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagagggacctgtaccgccccctctcttcggatgacttggattcagtaggagactcagtgtaaaagaaacaatggagcaatgtatatggtttgtgattgggtgaaggtttcacatttctgaagcaaaagtcttacagcaaaatacacaaaagagttttgcataccttgaaatgataaaagaccaaatcatccaaaagtaaatatgtatgcattttgttttcgtgatgttcaaccttgaaattgagagatttttaaaaatatctcccacatggatttgattggggagagtttgaacacaaaatgctgagatttttgtacagggcctggctctagatgaatttcatacacggacccaatattgagtacaagaacacactaaccatgtggcaatatagagccagaatttctgcagatggagttttcttcttaattataagtagacatagagatataatttttctgtactttctgtaaagcatattaaaacggcactagcaggcatattttttctaaaggttatattgtttttaaaatttgaattgcttggtttttagaggtacttttattacaaaataataaaaatgcttgggtagattttttttctccctagacagtagaaaaagctacttactgttttgtgggttagtacatccgagagaaaaagaaaaattatgacaacgacacatctcataaagactctgaagttaggctttaggaacttgccttgtttttgttgtcaagtaaattttattttttaaagttattttattagaaacagtataaatttagcttaagctatatgccaatatgaagaacttggccaatggcattgctatagattgtataattttttcttacaatcatatacataattttttaaatgtgtaaaaactaaagctgggaattttttttttt

SEQ ID NO: 12077 - DNA, 4961 bp, Homo sapiens
agcagccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtacgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcaaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttggggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactaacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacaaaaaaaaaaaaaaaaaaaaaaaaaaaaaaaaaaaaaaaaaaaaaaaacaaaaaaaaaaaaaaaaaaaaaaaagacacaaaaccacctagcccggtgcgaagcaccattcaaccctcacagaagaaggggataaagaacagaagagaaaacaacccagggacgagagcaaggacacacacagcacccgaaagatagaaagaaaaagacagccgcaagggagaagaaaactagcaaacgagcaagagcactacacatcgcgcgcaaacaagccactgagaccgacgccgccacccgcgagaaaccagacgcggaggaaagacacgagcgcgcaaaaccgagtggctaa

SEQ ID NO: 12078 - DNA, 3734 bp, Homo sapiens
agtttctgtcatagcagcccctgctagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttggggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactaacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacaaaaaaaaaaaaaaaaaaaaaaaaaaaaaaaaaaaaaaaaaaaaaaaacaaaaaaaaaaaaaaaaaaaaaaaagacacaaaaccacctagcccggtgcgaagcaccattcaaccctcacagaagaaggggataaagaacagaagagaaaacaacccagggacgagagcaaggacacacacagcacccgaaagatagaaagaaaaagacagccgcaagggagaagaaaactagcaaacgagcaagagcactacacatcgcgcgcaaacaagccactgagaccgacgccgccacccgcgagaaaccagacgcggaggaaagacacgagcgcgcaaaaccgagtggctaa

SEQ ID NO: 12079 - DNA, 1523 bp, Homo sapiens
agcagccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtacgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgtaagtgactcgcaccatttcctttgttctctcctaacattccttttaaaaatcagttgcagattttctaatgttattgcctccttttgaaagtgttgtgggccaggcgcagtgtctcacgcctgtaatctcagccctttgggaggccgaggtgggtggattgcctgagctcaggagttcgaggacagcttgggcaacatggcaaaaccccatctctaccaaaaaatacaaaaaattagctgggcatagtggcacaagcctgtggtcccagctactcaggaggctgaggtggtaggattgcttgaccctggaaaccagaggtggtagtaagccaagatcgtgccactgcactccaacctgaatgacagagtgagacatcatct

SEQ ID NO: 12080 - DNA, 577 bp, Homo sapiens
cttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactaacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacaacttggtgttttgtgttcaatgagaccttcctgcaacctgctccccatgggtggcagttaacaggcccatcagatattgttgaa

SEQ ID NO: 12081 - DNA, 6051 bp, Homo sapiens
gcacatccctgcactagtggccgcaaccgagacgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtacgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttggggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactaacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacaaaaaaaaaaaaaaaaaaaaaaaaaaaaaaaaaaaaaaaaaaaaaaaacaaaaaaaaaaaaaaaaaaaaaaaagacacaaaaccacctagcccggtgcgaagcaccattcaaccctcacagaagaaggggataaagaacagaagagaaaacaacccagggacgagagcaaggacacacacagcacccgaaagatagaaagaaaaagacagccgcaagggagaagaaaactagcaaacgagcaagagcactacacatcgcgcgcaaacaagccactgagaccgacgccgccacccgcgagaaaccagacgcggaggaaagacacgagcgcgcaaaaccgagtggctaa

SEQ ID NO: 12082 - DNA, 3482 bp, Homo sapiens
agcagccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtacgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcaaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctggtgatggggaccgtctttcttttactaacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacaaaaaaaaaaaaaaaaaaaaaaaaaaaaaaaaaaaaaaaaaaaaaaaacaaaaaaaaaaaaaaaaaaaaaaaagacacaaaaccacctagcccggtgcgaagcaccattcaaccctcacagaagaaggggataaagaacagaagagaaaacaacccagggacgagagcaaggacacacacagcacccgaaagatagaaagaaaaagacagccgcaagggagaagaaaactagcaaacgagcaagagcactacacatcgcgcgcaaacaagccactgagaccgacgccgccacccgcgagaaaccagacgcggaggaaagacacgagcgcgcaaaaccgagtggctaa

SEQ ID NO: 12083 - DNA, 702 bp, Homo sapiens
tgacctcaaatgatccacccgactcggcctcccaaagagctggaattacaggagaagctaaacgttttaaaataagtatattatttctgaattactataacagacatggactccatttgaacaagatacttaattcccatcaaaaacttgtcaaaatatacaaatttagtcacaagacactttactaccatctaccaaagctgtagtaaacacacacattttccatctttgaaatgaaataacgtataataatgttttccaaaataacaaagatgtctgcagtgaatagcactccctttgatgtggcaactgggtcaatcgtgttaacaactgtgaattcatctttttaagaaattcttttattgtttcttttcttttccgcgacagtctcactcgtgttgccccggctggagtgcagtggcgctatcttggctcactgcagcctccgcctcccgggttcaagcaattctcatgcctcagcctcctgagtagctgggattataggcacgtgccaccacacccagctaatttttttgtatttttagtagagacggggtttgaccatgttggtcagggtggtctcgaattcctgacctcagttgagccgccggcctcggcctcccaggaagtgctgggattacaggcatgagccaccaggcccggccttattgtttctatttgtaataaatctgttccccttgc

SEQ ID NO: 12084 - DNA, 373 bp, Homo sapiens
tgtagagatggggtctcactatgttgctcaggttggtcttgaactcctggattcaagtgatccacctgccttggcttcccaaagtgctgggattatagacttgtgtgactattagagtggtgagtgaataagctttttcttattttccaaatgcaatttatcagaaaatcctcttggctcaaaatatgtccagcatccaaccacatctcaccacctccaccactgtttccctgctccaagcttccacctctcttggatatttgcaatggcattttaaatggcctccttgattctgctctctccctcctatatttcccacaaagcagctagagtacactttttgaaacataagtcagatcatatcattcccata

SEQ ID NO: 12085 - DNA, 364 bp, Homo sapiens
gaaagaagacttttaataaactagtccttaaggctgatgaaaatattaattataaagcacacagagtaccttcccttagagaaacaattgattcattcaatataaaatctagaagtgactttttaaagtggtatgtctcctgcaatgatttctttataatctctctgtaaacactaagttctagtatagaattaaaaaattaagggccctaagttgtattgaattttaaaagaataaagtataaagaaaacattttctcctggcttacatttttctgtcataactatctctcattgaggaagttcttcctttctaaaataagtctctattttcatattgtactgtaaaaagagaaaaatataca

SEQ ID NO: 12086 - DNA, 305 bp, Homo sapiens
cgtcgcctactcttggactggacagaactcttcccagttccagctgctttttgtggtttggcctcctctgctttcccagggaggatctttctggccatttttggtgttgttggcccaggccccttggaggccacattgcttacttgcatcctctgctctggaggctgctgggtaggtcttgtagctgttggtggtttcctcacccatttgtattttggggactgtggggacgtggtttggctgtaaatgccatccgtaggctttaggtcttgctagctggttgcactttctgttctgaaggggac

SEQ ID NO: 12087 - DNA, 386 bp, Homo sapiens
cctctaaagtgggcttccctttcaccctaattccatcaagctctttaaatctcaattcaagtggcacttcctctcagaaacctttcaggaacctcccatgcctcccttctcccctcaggttaattacactgtcctctgggttcttttaattttaggtgcttatagccatctcaactaatccctgtaacaactaataattaccgcgttgtaactgtttaacaacacatccatttatcatattagactatgacctttattttccagcttattcttttttattttactgatacatgatattttatatattaatgagggcaccatactgcaagtattttttacatgcatagaatgtgtaacgatcaagtcagagtatctgaggtatccac

SEQ ID NO: 12088 - DNA, 979 bp, Homo sapiens
gaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgcacacaacctggagtcctagagttggaggaaccttgtatccatctgacttctcattttgcagaatatgatgagaacagtagaggatcgctctgttcaccactcttgctattccattagtggggagatgcctgctagcatgtgtgaggggaacactctgatacactgggaagtatcggaaattcccagaaacacaaacataaaataactctcctagac

SEQ ID NO: 12089 - DNA, 925 bp, Homo sapiens
gaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaattgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgcacacaacctggagtcctagagttggaggaaccttgtatccatctgacttctcattttgcagaatatgatgagaacagtagaggatcgctctgttcaccactcttgctattccattagtggggagatgcctgctagcatgtgtgaggggaacactctgatacactgggaagtatcggaaattcccagaaacacaaacataaaataactctcctagac

SEQ ID NO: 12090 - DNA, 415 bp, Homo sapiens
aagttactctggagtgggaaggcttggaccagtcttgggaaaacaaatgggaattagcctgggcagagaaaaggggaaggggttgttatgggctgaattgtgtcctcccaaaattatattgaagccctaacagccgtaacctcagaatgtgactgtatttggagacagggctttggggtgattaagttcagatgaagccgttagggtgggttctaatccagtctgacagttttccttataagaaggaaatttgagcacaaaaagagacacaggagttgcacacacaaaggaaagaccatgtgaggattcatcaagaagaccaaggagagaggcctcaggagaaaccaacctgccaacaccttgattttggacttccagactccagtattgtgaaaaaataaatttctgttgttga

SEQ ID NO: 12091 - DNA, 285 bp, Homo sapiens
ctccacaaaaaaatttaaaaaattagctaagtatggtggcatgcacctgtggtcccaactacttgggagggtgaggcaggagaattgcttgagaccaggatgatcccttgatcctggcagggggtggagttgaggccgcattccaacctgggcaacagagtgagaccctgtctcaaaagataaataaaaaagaatagacatataatatgtaacttccaaacaaatgaaagggaaataaaggagtacgagaagaaaggcaaattcaatgatccaaaacaaagtgag

SEQ ID NO: 12092 - DNA, 623 bp, Homo sapiens
gtcgtttgaagtgagacagggcagtcccttggcctcaccttccacctcggacacctgtgctgagcctgtggcatgtcaccatacctaaactcatggcaggatgagcgccctggcagtgggaacaggccatgcagaggccccggggagggagtaagctaggtcagggggctgagtaaagacaggttcttaaccccatgaggctccgtgggtgactctgggtgggatgggggctttagcaggggagagttgggacctgcttggagcgaaggccactctggttgccatggccacgaggacaagcaggggactgtgggaagctgatgctgtggtccagttgagacaagacttgggtggcagagagacagtggacagggtggagccgtgaagtcaccctcccagtacatgagagaagacgtccaagcccagtccctgacaccagtccagccagaggcagggaggagagcagagtggagggacacaggatgacagtggggcgtggggaggccagcctctgctgtgagagctctgagatagggacgatggtacctctgaccttccctacccctccaagccctctgtcctgctggaaggagatgccaggaggagacccaggtgctgaggag

SEQ ID NO: 12093 - DNA, 480 bp, Homo sapiens
gctcagctggggtattttattagcaacgattctaccagcttggggaaggcatctagaatccatgctcagaatcactaagctatcctgcctctaactgtggtaataaatacatggtatactctttcaccatcaattttacctttaagataaaataagaaacaatcattcccacaatacgtaaaaattttccacgttggttaatagatgacagagatgaaatgaaaggcatgggcacacctaaaataaatgcttctatttttgcttctgtatgacatctccgacaagcaatggattttagcctgttgttgactgtcagtgacatacctacatttatgaaatttttcaacaccatgtaggcctgtggtgctaaggtcggacatgtgaaatacatgcaggaattaaatttccacaattgttcaatttccaaacttacccaaattaacaaagcaatacataatattatcttaggaaaatagtacc

SEQ ID NO: 12094 - DNA, 523 bp, Homo sapiens
gaggccaaggcgggaggataacttgaggtcaggagttctagacaagcctggacaacttagagtcctgtttctatgaaatactaaaaatcaaaaataaagaaataaaaatttttttttgttgtagtgggtatgtctgtggtccccactctcaggaggctgatgtgggaggattgcttgagtcaagagtttaaggctgcattgagctatggtcgtgccattgcactcttagctgagcagcagagcaagacgctctcttttttttgagatggagtcttgctctgttgccaggctggagtgcagtggcgcaatctcatctcactgcaacctccacctcccaggttcaagtgattcccctgcctcagcctcccaagtggctaagattgcaggcatacgccaccatgcctaattttttgtattttagtagagacgggatttcaccatcttggccaagatggtctcgatctctccttaccttgtgatctgcccatcttggcctcccaaagtgctgggattacaggcatga

SEQ ID NO: 12095 - DNA, 592 bp, Homo sapiens
aaattcagaacatagcaaaaggttctggctaacatgcagaacagtatgtctggactcccactactgttggtctgcaaagttgaaggctactctaggcaaatatgtcacctttaatgtatctccttaggaggagtctttcaccttattcatgctcctcagcacccacaccaaaagattcatgaagtaaatgttacctagtctctgctttaccccattacccccggcctgaggacctttgaaccattttaaatgctctacctgccagcctggccatctgtgcattgcttgctccatccacccttctgactcagctgaaataccaccttcccaaagaagtctaagtgaccacctcatctaaattgggtttcctgcccacccctcctctatcactttgcgcatggttgtatttctatcacagaacttccgtccatcattcgtgtccttcgttttgtacttgtttatcatatatcctctgtagaacagaacattctgagaagacggactttgggtgtctttctacaaaatcctccattcctaaaactgctttacctgtagatggtcctcaacaaatatctaaaacattttaaataac

SEQ ID NO: 12096 - DNA, 365 bp, Homo sapiens
ccacgttccaggaggttgtccaagacactacctggaagaaaggctactaatcacagctactctgaaataacacaatgtgcccagaaagaactgtttgagagaactggaaaacatctactttatgtttgataggtctcaaatttcaaaaggtcaaatttcattacatttcaatgtaatcatggaaggttcaatgacaaagtcagactgtatggaataacaagaacaactaaagcctattaacaaaacaaagagagaactgagaataattaggataaggggtcaataacaaactgagggaaaaggttaaaatagggtagattatgcaacagaaacaactcccaaattacagtagcctaacacaaagg

SEQ ID NO: 12097 - DNA, 735 bp, Homo sapiens
taggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttaattgcagtttaattattatgccttttggggttaaatgatgtgaagtgtttccacctactgataaataccatatgaaaacacgactaaaagactgatttaagaaacttgttatttttaaaaatatgaatttcaaaagaaatgttctcaaagacacatgcatttattttaaattcaaaaaattcttatgaatttattattgcttgtactttaactttttttattgtagacaatcctaagtgaataatgtctcatgggagaacacatgatatgtgcttgtatttgtgtaatctgatcatgcactcaatggttggaaaaggcactccagtgctaagaaaataaccagaagccaatatatcgattcttatatctcggtttatgttaccaactgaatatggtgtaatgcataactttttccagtaaataaactggttattttttgttca

SEQ ID NO: 12098 - DNA, 425 bp, Homo sapiens
acaccagactttggaggattaaaggagcaaagacttatttcttggttgcactaaaagtctgttatgcgttggctgtgagtctgtttcacgttgtctgcgatctggaacccaggctgctgtggtggttccatatggaaagttcccggtgaccaccgaggaggaagagagtgtggcaaaatgaagttacttccctgacgtcctcagtccacgaaagtcatgtggccacaccacattcaagtgggcaagaaatcaaaccacatgatctgaaagagacctttgtgaatatttccaaataaccgcatgtgacctccacacttagctcccttacatcttcagttttggtcgggctcagtggctcacgcctgtaatcccagcactttgggaggctgaggcgggcagatcacctgaggtcaggagtttgagac

SEQ ID NO: 12099 - DNA, 1065 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccggtcagtccctcctctaaaccctgctgtctccaggcgacaggccccaagccagcccttgccctggcgagaggtgtgccacccaaggcaggtcaccccagtgctgtcccaaggaagctggcacgggctgcattacctttgctctcaaactagggtgtcc

SEQ ID NO: 12100 - DNA, 2477 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12101 - DNA, 2554 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacggtgaggccctcccatcccccctgctgtccaccttcaaagcaccagggcccccgcttattcttgccccgtccacacagggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12102 - DNA, 2574 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacaggtggctgccccaccgccctcatcctgacccccagccccggtagagccctgactgggagctagccccaagcttctctttccttacctcctccctgcagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12103 - DNA, 2562 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggttggggggaggcccaccctgtcattctgccctgtgcgcccccgccctcaccctgcccaccgctcctgtcctctgctccctgcaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12104 - DNA, 2438 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12105 - DNA, 2214 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12106 - DNA, 2035 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctgtctggctagtgggggctgtcgggctagtcggggcctgtcgggctagtcggggactgtcgggctagtcggggcctgtcgggctagtcggggactgtcgggctagtcggggactgtcgggctagcgggg

SEQ ID NO: 12107 - DNA, 2080 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagtgagtttcccggggaggaggtgtgcctggtgggagatccccggggtttgggaatgggcagggaaggacagtgaggtactctgctgaagtttcagcggtgatactgcaggccgtggcagggaagtaagtggtggggctccctaggagctcccaagcagaaggaattctcgcgggagcagcaggaattctcgcgggagcagcaggaattctcgcggggcagcaggaattctcgcgggagcagcaggaattctcgcgggagcagcaggaattctcgcgggagcagcaggaattctcgcgggagcagcaggaattctcgtgggggcagcaggaattctcgcggg

SEQ ID NO: 12108 - DNA, 1669 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggagccatgcgagctgctccccaggccaccccgctgatggagccccaccttgtctgctaaataaacatgtgccct

SEQ ID NO: 12109 - DNA, 2626 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccggtagtcccccgtccgcgcgacgagccccccacgcccggcagaaacccccacctatggccggtggaagtccttgtccccccgtggaaccccccatgtcccacgaccggtctgtccccgcgctggtctcagcgcagttacctcgtttccagacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12110 - DNA, 2361 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12111 - DNA, 1678 bp, Homo sapiens
agtccactactgcaccggcacacctgcaccggtcccacacctgctccagccacacctgggcttgggccgccaggtccaccccaggccctcaccagctgctggcgccaacatctgtggaacagagtcggtgaagaatgggggccagacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12112 - DNA, 2458 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcgatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacaggtggctgccccaccgccctcatcctgacccccagccccggtagagccctgactgggagctagccccaagcttctctttccttacctcctccctgcagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12113 - DNA, 1097 bp, Homo sapiens
cttcaccgactctgttccacagatgttggcgccagcagctggtgagggccctggggtggacctggcggcaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccttggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12114 - DNA, 786 bp, Homo sapiens
gccaagcatgtagagttggggagaccactccgtccaacacgctgtagcgttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaaaaaaaaaaagaaaaaagagcgggacacgccaagagattcaccagagggggcacgagatcaagcatcccaatttcttgtaacaggggccaca

SEQ ID NO: 12115 - DNA, 1650 bp, Homo sapiens
tctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttgggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggtgagtgtctggtgcggggcaaggcaagggccgggaaggaggagccccatcttggcccgaggtcccccaatcccaccgccttcctccccaggcttcgacagcagcagcaacgtgctagcgggccagctgcgaggtgtgccggtggccgggaccctggcccactccttcgtcacttccttttcaggcagcgaggtgccccctgacccggtcagtccctcctctaaaccctgctgtctccaggcgacaggccccaagccagcccttgccctggcgagaggtgtgccacccaaggcaggtcaccccagtgctgtcccaaggaagctggcacgggctgcattacctttgctctcaaactagggtgtcc

SEQ ID NO: 12116 - DNA, 206 bp, Homo sapiens
ggaagtaagtggtggggctccctaggagctcccaagcagaaggtgagcacaggtgtccttgactgaggcggggcggggagcagggggacaccagggtgaatcaggaagacccgaggggtggcccccaccctttctccacccacgcggcaggttccaggtgccctggctggagtcagtcctcatcgtagtcagcaacaacattgacg

SEQ ID NO: 12117 - DNA, 2960 bp, Homo sapiens
tggaaatatctgtatgtttctttttcctgagatcaaaaaagttaagaaatattgaactgtacaattctttgctgtggtgccattttctaagaaaatcttcacagtccatgattagtgagaaaaagcttttattttagattgccttttttcttttttgacttttttaaatttaaaaaccatcttttcttaaatgttagtaatagtagttgttcttttctgaatctcatttgaaaaaatgaaaagttggtaaaattatatttgttcttataatttgaaggaagtttcacttatctgttaaattcagaagtcagagatacatgctttataccttaaaaaaaaaatctgtgactcctcactttggaggtaggtttctgtatattcgttagagaaaggttattaatgttctttgtcagtgtttctgccttttactgataattttgtctgcttgaactgtcagtatctgatagaagtggatatggcttctcatcttgaattgtgatccccataatccccacatgtcaagggagggacacgatgggaggtgattggatcatgggggtggtttcccccatgctgctgttcttgtgatagtgagttctcatgagatctgatggttttgtttgttcgtttgagacaaggtcctgctctgtcacccaggcagagtggtgcagtggtggggtctcagctgattgcaaactctgcctcctgggctcaagtgattctcatgcctcagccttcctagtagctgggattataggcgcacaccaccatgtctggctgatttttgtatttttcatagaaacggggtttcaccatgttgaccaggctggtcttgaactcctggcctcaagtgataacacctgccttggcctcccaaagtgctcagattacaggcatgagccaccatgcctggtcgagagctgattggtttataaggcagttttccctgttctcgtttgctttctctctccagctgcaatggaagacttgtctcttccccttctgccataattgtaagtttcctgaggcttccccagccatgtggaactatgaatgaattaaacctcttttctttataaattacccagcatcgggtatgtctttatagcagtgtgaaaacagactaatacagaagtatatgttaactttctctgctgagcatgttggtgcttgcctgtagtcccagctacttgggaggctgaggtggaaggatcatttaagaccagcctgggcaacatagggagatcctatgtccaaaaaaaaaaaaaaaaaaaaaaaaaagcatgttaaatttttcatcagagttgacagcttctcaaatggtcagtttttgttatatacattgttgaggctgtgtgttagaaactttcagattcatgaacattattcaatgttctttgtagtttgttccttttattgtaatatagtctctatccctattaatgctttttcgctactgatacctgacttttttccccttaatctttgacttgtaatatgtgagattaatctatttgaataagtagacttatttctgctctctgaattttatattttctgatccatttactttgctgtgtgtgtgttttgtttttgtttttgtttttttttttttttgagtctagctttgttgcccaggctggagttgcacgatcttggttccctgcagtctcagcctcccaggttcaagtgattgtcctgtgtcaatctcccgagtagctgggactacaggcgtgtaccaccatgtgtggctaatatttgtatttttagtatggatggggttttaccatgttggtcaggctggtctcgaactcctgacctcaagtgatgtgcctgccttggcctcccaaagtgctgggattacaggcctgagccaccgcgcccggcctctttgctgtttttttcctcttctgttagatggttagttttctgcactcctttttttccctccctcttgattcgaaagtcatagactatatttccattattttaatggttactgttaaaattttcagttacgaagttttctactaaaaatgtgggcctaactggcttctaggatgaacccagctctggcacccagtctcttttactctgtttttcttgtgtggagatactcatcttgtatctcatctcagctttgtcttttggttttctcttttttacagttgcctttcatagctacatatttagagtaggagaagtcttcctcagggtgaactcaatgcatcatctctacttcagccattctttcactctactggtttgcatatctgcacataatattcagtaaatacttgttaagaagtgtttcttatatttttttcctttttgttttagttttactcacttttttcagcttttgatggaaaggagagaaagtggagataacaggaccaaccacatctgtagaatggtttttacactgactgtcgacaatcagggttggtggagtggtcagggtaagaaggaggtatagagaatttagtctgggacaaaggaactgtatggtccaagtgtgaattgacacttattatgacaatattatggcaatattatttattgataatattctaataagactgcctccattttgttaggtttgttttctgtttttatacacaccgaagtattaaatagatgccagttatttttgtagaaaacaggagggctacactgctgtattgtagctatgatgatggcgaccgcgttttacaaacatttgtgttctcctaacatagtgattaattactaggacaggtttgagatggtggcagttacaaagagcatctggctggagatgagtttagtgttcgcatatacccctactcactcctccaccatcttcccctttcagaaaccgagagaggaggtagctgatgataccaataaacttgttatgctttgagatgtatctctgtaactagcaagtgatttccaggcatttttaaaaaaaaaaa

SEQ ID NO: 12118 - DNA, 630 bp, Homo sapiens
cctggtgccaaggaaacttgctgaagggtacccgctgttaaactgcatagggcagcctgccactgctgtaaaccctgaccgggataaccgcgtgccgatctgcctgccactatatgggaaaacagaaaactagatgaagaagaaaaaggcctctgtcttccagccatgcattgttccttccacactccttattgtcaaagcctaacatggagccagctggcaaaggaaaagtgtggcctgtagagttcagccccagtattacaaagcaggatgaagaaattgggattggagctgaaagacaataaattaataactgatacagatggaaagtacatttttcaacccaaggatagaaagaagccccaaacatcatcacacaaaaggaagacagattggctgagagaggcatttacattaaaaaaataaaatactgaaggtttacagggacacatctcttggagtagagcagcctacctccaaggtattggataagcaagacaaggtgttataaagcctattgtgtaaatatatacagaagactgagaggttttcaaccgaataaatgaatgcctggtacagcgttaatatagctgagaaattcatcctgtaacaagttgagtcaaaaaaaaa

SEQ ID NO: 12119 - DNA, 723 bp, Homo sapiens
  misc_feature (640)..(640): n is a, c, g, or t
gcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctgatgtaaaaaaaaaaaaaaaaaaaaacttcctcgtgccgatttcggcacgagttttttttctttttttttgcacttcccatgagcattnttattaaattgaacaagttgtagattcgataattccaagacttggacaaaattcacaacgccctgtgagaagccttggcttgt

SEQ ID NO: 12120 - DNA, 645 bp, Homo sapiens
  misc_feature (92)..(92): n is a, c, g, or t
gaatttgaggaagaagaaggtgagttagaggaagaagaagaagaggaggatgaggaggaggaagaagaactggaagaggtggaagacctggnagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagcctccatgctggccgacttcatcgattgtccccctgatgatgagaagccaccacctcccacagagcctgactcctagccatcttctgcaccccactctttgtttccaataaagttatgtccttagat

SEQ ID NO: 12121 - DNA, 324 bp, Homo sapiens
tctaacgatttttacttttttccttaagtatttttaaaaaatagttctagaactgactttcatgcagaatttggtaaattttttctataaagaaacatgataaatattttacactttgcagctgcataataatctgtcatcagcaacactaccactatcactactactgcttcctcctccttcccccttcttcccctcctttctcctctttcttctttcttttacctttccagtagtgctaatcttcattcttcctttctttctcctcctcccctccttgcaccggcccttcctggtctttgaataaagtctgagtgggcggca

SEQ ID NO: 12122 - DNA, 263 bp, Homo sapiens
gaggattccccaacttcgatcgcggagaagtgcaaaaggaggaaaaaaggaagaaaaatggaagggaggaggagaaagaaagcaacactaccactatcactactactgcttcctcctccttcccccttcttcccctcctttctcctctttcttctttcttttacctttccagtagtgctaatcttcattcttcctttctttctcctcctcccctccttgcaccggcccttcctggtctttgaataaagtctgagtgggcggca

SEQ ID NO: 12123 - DNA, 741 bp, Homo sapiens
atacattctttcttttcagtatataaattttaatatgcattccatatctctccagccatatttcctatatcaatagtcccctgtggcaactttatctttgaatacaaactacgcatgttcaatatttgagtagtgataatgggttttattctataaataacagccttagtaccctaaactacagccagcataactttaccatttgcaggaactactgtgctttatattctaaatggctgttttaatgttttattcgttaccagtaaacaaacgcaggacataggaagaagaaaacttcattagcatggaataagcaaatctatcattctggtagtggggtgtcctctatccactgggctggtgtgcctcaactgctgaaatacagtgttccagggcccttctagaacgttttcacagtacaagttatatttgaatcatcaatccaaatggccttgtgctgacaagaactccaaattgtggaagaatcttttaaaatgttattttttcagagttagtttaaaaggttcctgccccctgcaagttatgctcaatagcctatttctcaaactcttcctcagaaatagaaaataattccaggtgagtgtttgaaagtagcctgctgttggccagctgtggggacacatgcttgtagtcccaactactctgaaggctgagatgggaggataccttgagcccaggagttcaagactagcctgggcaacatagacctcatctcttaaa

SEQ ID NO: 12124 - DNA, 288 bp, Homo sapiens
taacagccaaatggctcatggctgtacttttcccaaggcaaagcactgtctatatccaacaaggattaagaatactaccttttgcaacaatgagaaatggcacaagtgttgaaactatagttttattaaagccctccatgagcccatgctaatttattcagggatgaggattccagagcaaattatttcactgtttttcacctctacctcccccaggatctctgcaagaggaaaagtttttccacctacaactacctcttataggaggtagggaacctgggtaaagga

SEQ ID NO: 12125 - DNA, 549 bp, Homo sapiens
ccctacggcctctacctctgttcacatcttgtgatggggtcaaggttgccctcccagagtagaaggacaggcaaaaggtgatgctgcaaggatggtgccgagacagcagtggcacgctgcaggcgctgcccgggccagggaacttaatggagtggggacggacgtgcggctccactggttcccggactcctggtctccactgctgggcactcaggatctgcccggaggccttggacacaggcaccactggcagagcttgcccatggccctgctgccccactgcatggcttcgggctgccccccgaggggtcagacctgacgcccccaccatcagctttcctgtctgaggggctccgggctgcttccctcccacctggggctagactgtgtgtggttcagagggagatgctgggttgggggcgcccaccacactggcatggggaccctgggccagcgggccctactctgggtggtggtttctcccctctaagacaaagaagaagtgggttgcaaatctttctgtaaataaaatgccacatggcacccaag

SEQ ID NO: 12126 - DNA, 434 bp, Homo sapiens
ccctacggcctctacctctgttcacatcttgtgatggggtcaaggttgccctcccagagtagaaggacaggcaaaaggtgatgctgcaaggatggtgccgagacagcagtggcacgctgcaggcgctgcccgggccagggaacttaatggagtggggacggacgtgcggctccactggttcccggactcctggtctccactgctgggcactcaggatctgcccggaggccttggacacaggcaccactggcagagcttgccggctgtggtggctcatgcctgtaatccagtgctgtgggaggccgaggtgggaggattgctcaagtccaagtgtttgaggccagtctgggcagcatagtgagaccacatctctaagacaaagaagaagtgggttgcaaatctttctgtaaataaaatgccacatggcacccaag

SEQ ID NO: 12127 - DNA, 1177 bp, Homo sapiens
catggttcaaactgacattttaattaaatgtgatgataggttgagcaacctagcagtactctaaaatgacttttggttatggctttttccatattatgtttaggctgaggcatccctaaatgattcaattgtaattccccttcttaaacatgagatttatctttacaaaataatttattttcttaaaattgcaagttaattctatagttcatgcatacataatctcagtagatatcagctgtatgtgtacacacatacatataggtatttgtatatacacacattacataatttaaaaaaaaacttattagcagggtacaaccacgaagacaaagaggctttgtgtaatgtgatggaaacacaattgcaggacaaacaacaggctgctgtgagggctgtatttaccctttctgatgtaagacttggaaaaacatggatactggatatttaatccccataacagaaaatttagggtgcagacaacttcccacaatttttacagacaatgtcaatagaaatgcattcaatgcagggaatacacagtgtgacagtatccaaaaataagcaggttgatggtttagatttatgagacaagagaaagaaatagtagatgatgtcataattctccttttatggagttatgaaagttcttcattttatataaggtcaggtgctttcaaatgtcaatgagaaaaatatttaaaggaagaatcaaatctaagatgtagagagatctttataaacgtgaacttcaggccaggcacggtggctcatacctgcaatcccagcattttgggaggcctaggtgggccgatcacgaggtcaggggatcaagaccatcctggcccacatggtgaaaccccgtatctactaaaatacaaaaaatcagccaggagtggtgacgtgtgcctgtagtcccagctactcaggaggctgaggcaggagaatcgcctgaacccaggaggcagaggttgcagtgagccgagatagcgctactgcactccagtctggtgacagagcaagactccatctcaaaaaaaaaaaacaactttttttcatgctgagaagatataatcatcaacacattcttgagcacaactatgcacacaggcacttccgcattcacaagccatgctgtgtgcacacactgatgcccctagattccttttttgaagag

SEQ ID NO: 12128 - DNA, 1123 bp, Homo sapiens
catggttcaaactgacattttaattaaatgtgatgataggttgagcaacctagcagtactctaaaatgacttttggttatggctttttccatattatgtttaggctgaggcatccctaaatgattcaattgtaattccccttcttaaacatgagatttatctttacaaaataatttattttcttaaaattgcaagttaattctatagttcatgcatacataatctcagtagatatcagctgtatgtgtacacacatacatataggtatttgtatatacacacattacataatttaaaaaaaaacttattagcagggtacaaccacgaagacaaagaggctttgtgtaatgtgatggaaacacaattgcaggacaaacaacaggctgctgtgagggctgtatttaccctttctgatgtaagacttggaaaaacatggatactggatatttaatccccataacagaaaatttagggtgcagacaacttcccacaatttttacagacaatgtcaatagaaatgcattcaatgcagggaatacacagtgtgacagtatccaaaaataagcaggttgatgtttatggagttatgaaagttcttcattttatataaggtcaggtgctttcaaatgtcaatgagaaaaatatttaaaggaagaatcaaatctaagatgtagagagatctttataaacgtgaacttcaggccaggcacggtggctcatacctgcaatcccagcattttgggaggcctaggtgggccgatcacgaggtcaggggatcaagaccatcctggcccacatggtgaaaccccgtatctactaaaatacaaaaaatcagccaggagtggtgacgtgtgcctgtagtcccagctactcaggaggctgaggcaggagaatcgcctgaacccaggaggcagaggttgcagtgagccgagatagcgctactgcactccagtctggtgacagagcaagactccatctcaaaaaaaaaaaacaactttttttcatgctgagaagatataatcatcaacacattcttgagcacaactatgcacacaggcacttccgcattcacaagccatgctgtgtgcacacactgatgcccctagattccttttttgaagag

SEQ ID NO: 12129 - DNA, 364 bp, Homo sapiens
ttgtcagggaaaggagaattcttagaattccgggaagtatggaaaaccttcccactagcataatttgccttttggccatattggattgtgttgaaatgtgcatctatactgagataagggtgagagcccctgtccactgtcagcacagtcactactagaaggcccagaggaagtcccgtgacaagcagacagcatgaactggcacaattgtgcaatcatttcttcacagaccttctcaaggcacagcaattctcatttgataaagggtatggagagaaatttctaatataacaaaaacaaatcttgtcacttgaatttattttccgaggcaaacaaacaaaaatcaccttcatgacattagatg

SEQ ID NO: 12130 - DNA, 1222 bp, Homo sapiens
atttaccaattttttggggtgtgagcacttaatatctattctctcagcaattttcaagaatatactacattgttgttaagtataatcaccatcttttacaatgtcttctgaacttattcctcctacctaactgaaatttcatatcctttgaccaacatctccccagcccacctccatcagtgaccaccattctattctgtgcctctatgagttcaactttgttagattccacataggagatcatgcggtatttgtctgtgtgtggcttatttcacttaacataatgtcctccaggttcatacatgttttcacaaatgacaggatttcctcatttttaaggctgaatagtattccactgtgtgtgtgtgtgtgtgtgtgtgtgtgtgtgtgtgtgtgtgtgtgttttctttatccttgcatttattgatggacacttaggttgattccatattatgggaatacagatatctcttcagtatgctgacttcatttcctttggatatatacccaagagtgggattgtcggatcatatggtagttctatttctaattttttaaggaacctccacagttttccataatggttgtactagtttacattcccactagcagtacgctaagggtttccttttcctcacatcctcaccaacacttgtgatcattttggcattccttgcagttgcaccactccagtctctgcctccttggtcagcttgtctcttcctcttagtctgtctgtgtcctctcctcttttgtttcttataaggacattcgtcattggatttagggtctacctgagtataatctaggatgatcccatctcaagattttaaacttaattacatctgcaaagacccttttcccaaataggttacattcatatggtctgggtattgggatatggacacatctctttggggggccaccattccacccatatagatacatattcttttttgttgtgttttgaagacaaaagcatagatttattgaagcaaaaatacactccacagtgtgggagtgggctcaagcaagtggctcaagagcggtacatattcttattttcccaattttatagagatacattgagtaagcagtgaagctggcactggccaggcattatgactaggagctgcgcatctccaccaccacactgtgatggcatgctaatttattctgatttgtagagggtctgttttgaggcattctctgtatgaaatct

SEQ ID NO: 12131 - DNA, 398 bp, Homo sapiens
atcacccccaaaacaaactctgcacattaggtcatacaccatttcccactcctcccagcccctggcaactgctgatttacttcctgtccctatgcatttgccctttctgggtatttctttttttttttttttttttttctcttttctttttttgagatgaagtttcgctcttgttgcccaggctggagtgcaatggcgtgatctcggctcaccacaacctccacctcccaggttcaagggattctcctgcctcagcctcctgagtagctgggattacaggcatgtgccaccacgcccgggtaattttgtatttgtagtagagacgggatttctccatggtcaggctagtacctaactcccaacctgaggtgatccgcccacctcggcctctgaaagtg

SEQ ID NO: 12132 - DNA, 268 bp, Homo sapiens
ctgttctctgtttttattttatgcaactgctttttcagatatgttgtgaccttcgtaaatgtaggttgggaggaacaaaacattattaagattttcctatgtatgttttatatacatcatttccttttaactttcacaatagccctgtaaggtaaggatcagtagccccagtttacagatgagaaaacggagtctcagaaagtagatcacttcttgcaggctaatatgtgtcagcatcatattcagaaccaggaatagaaggcaaact

SEQ ID NO: 12133 - DNA, 1345 bp, Homo sapiens
catattagtgcatttctttgcagaggttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtgagtcactctctctacccacttcctacctggactttctccttctgcccattgtagaggataaaatggaaagcataagggtcacttctgacaaatgcatagtctattgatggcaaggaaaatacaacatgaaaatcatattataaattttacatgaaaactaaagctatagtatcatctcatattccttgcaaggagaataaaaaa

SEQ ID NO: 12134 - DNA, 1687 bp, Homo sapiens
catattagtgcatttctttgcagaggttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggttactgggtctgatgcttggttgggtaataaatagagagcaaataatatcaaaataaccatttctgtgcagtgctaaaaattataatttttaactgtatttttctgactgttctgctagaggaaatggaaacattgcttgactatatcagttggaaccaattttaaattgcattacctacctcttcttggagactttcctttctctacccctttaattttttatttcttcttcctaataaatttcctccttacatgggctttgtgaaaattataaaattgaaagatcatatttgaagtaattaatttgaagttttactacttctaattttcattcctgtaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtgagtcactctctctacccacttcctacctggactttctccttctgcccattgtagaggataaaatggaaagcataagggtcacttctgacaaatgcatagtctattgatggcaaggaaaatacaacatgaaaatcatattataaattttacatgaaaactaaagctatagtatcatctcatattccttgcaaggagaataaaaaa

SEQ ID NO: 12135 - DNA, 2860 bp, Homo sapiens
tccaggagcccagcgcaggccgcagagccggggccgctgtgagccgagaccgcgggccgcggagctcgggcggccggcgcggagaatttgttcctgttgaagagtggctcctcttctaatttccagactccttgaggttttaggagtctggtaggtgaaattttctacctctaaggagaaacagtacctgctccttcctcaagcgcaagccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagttcaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatgcaaaaaaaataaaagacaaaaacaaaaaaaaaacgtgtttgggcgccgagcacttggccccttgagaaaaagcgtcttttataaccccattcttgttttgggcagcggcaggccccctagtatggtatgggtgaacaacgttggtaatagcggtttccccagagggaaacccccggggcaaagactagagtgcagggagatcttccacacactatataaaaaaagccgcgggggggaaacacagagggtgtccgaaacacttcccagagaggaggtaccgaggcggacacagggacgtcatcaaaagggggtcccacggcgaagcgagaatataaatgcgcgcccacgcatgtacgcaaacagcacgactaggtagagtcacaaagaggaagaggcgggcggacaagacaaagacagaggacagaaagagaaaaagacaggaccgggagaaaggaggggaaaggagagaaagcaagcaagcggaagccgaacagaagccggaacgaaccccggcggagcgaaggagcaggaagaaggagaagggaagacggggagaaagcaaacacaagagagagcacagcgaggcaagcaagaagtgacgaaagtcagcaaaggaaaaaggaagccgcgtagaacgcgacgaacggaagcaacgaaagaacgaagggagaagaagggaagaggacagcagaaaagggcacacatgaggaagaagaacgacgaacgaagcacaagcgccaagtaagaaagaacgagggagagaagagaggagggagagccagcaggagagggagaggcgagagaccggagggccacaagcgagcaaggagagaagggggggggggcaagacaaacccagggggacagcggcagaggaggaggcgacaggaagaggagcggagagcgaacgaggaagacggacgggaggaggagcgagaggagagcggagggggggagagaggagagaggagaggaaggcaggggagggggggagaacaggagagagaa

SEQ ID NO: 12136 - DNA, 2233 bp, Homo sapiens
tgaaggcgggagtggagctgccgtttgtggtttggtgctgtggtgcctgttaaaagtggctttaatgagagtgtaaggtgctgcacactgaagccctgtgtttattcagctgcctcctgccagcggctacagctgggatggcttccctcgcacggcgtctgcccacagccttgcgcccggagcccagaggactcacaggaaaaggagctggcaaaggtgaagctggttttcatggtctcctgagggcccctggcccctgggagatgggtcacactccctgaatgctgtgctgttggtttccctggaggattcttgctgcaggccaggtcccgtattctccacactcaccacaagtggctgggtgtgacttgacacggtgtgaaagtggaggggcgcgagcactcagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatgcaaaaaaaataaaagacaaaaacaaaaaaaaaacgtgtttgggcgccgagcacttggccccttgagaaaaagcgtcttttataaccccattcttgttttgggcagcggcaggccccctagtatggtatgggtgaacaacgttggtaatagcggtttccccagagggaaacccccggggcaaagactagagtgcagggagatcttccacacactatataaaaaaagccgcgggggggaaacacagagggtgtccgaaacacttcccagagaggaggtaccgaggcggacacagggacgtcatcaaaagggggtcccacggcgaagcgagaatataaatgcgcgcccacgcatgtacgcaaacagcacgactaggtagagtcacaaagaggaagaggcgggcggacaagacaaagacagaggacagaaagagaaaaagacaggaccgggagaaaggaggggaaaggagagaaagcaagcaagcggaagccgaacagaagccggaacgaaccccggcggagcgaaggagcaggaagaaggagaagggaagacggggagaaagcaaacacaagagagagcacagcgaggcaagcaagaagtgacgaaagtcagcaaaggaaaaaggaagccgcgtagaacgcgacgaacggaagcaacgaaagaacgaagggagaagaagggaagaggacagcagaaaagggcacacatgaggaagaagaacgacgaacgaagcacaagcgccaagtaagaaagaacgagggagagaagagaggagggagagccagcaggagagggagaggcgagagaccggagggccacaagcgagcaaggagagaagggggggggggcaagacaaacccagggggacagcggcagaggaggaggcgacaggaagaggagcggagagcgaacgaggaagacggacgggaggaggagcgagaggagagcggagggggggagagaggagagaggagaggaaggcaggggagggggggagaacaggagagagaa

SEQ ID NO: 12137 - DNA, 2043 bp, Homo sapiens
tgaaggcgggagtggagctgccgtttgtggtttggtgctgtggtgcctgttaaaagtggctttaatgagagtgtaaggtgctgcacactgaagccctgtgtttattcagctgcctcctgccagcggctacagctgggatggcttccctcgcacggcgtctgcccacagccttgcgcccggagcccagaggactcacaggaaaaggagctggcaaagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatgcaaaaaaaataaaagacaaaaacaaaaaaaaaacgtgtttgggcgccgagcacttggccccttgagaaaaagcgtcttttataaccccattcttgttttgggcagcggcaggccccctagtatggtatgggtgaacaacgttggtaatagcggtttccccagagggaaacccccggggcaaagactagagtgcagggagatcttccacacactatataaaaaaagccgcgggggggaaacacagagggtgtccgaaacacttcccagagaggaggtaccgaggcggacacagggacgtcatcaaaagggggtcccacggcgaagcgagaatataaatgcgcgcccacgcatgtacgcaaacagcacgactaggtagagtcacaaagaggaagaggcgggcggacaagacaaagacagaggacagaaagagaaaaagacaggaccgggagaaaggaggggaaaggagagaaagcaagcaagcggaagccgaacagaagccggaacgaaccccggcggagcgaaggagcaggaagaaggagaagggaagacggggagaaagcaaacacaagagagagcacagcgaggcaagcaagaagtgacgaaagtcagcaaaggaaaaaggaagccgcgtagaacgcgacgaacggaagcaacgaaagaacgaagggagaagaagggaagaggacagcagaaaagggcacacatgaggaagaagaacgacgaacgaagcacaagcgccaagtaagaaagaacgagggagagaagagaggagggagagccagcaggagagggagaggcgagagaccggagggccacaagcgagcaaggagagaagggggggggggcaagacaaacccagggggacagcggcagaggaggaggcgacaggaagaggagcggagagcgaacgaggaagacggacgggaggaggagcgagaggagagcggagggggggagagaggagagaggagaggaaggcaggggagggggggagaacaggagagagaa

SEQ ID NO: 12138 - DNA, 1076 bp, Homo sapiens
tccaggagcccagcgcaggccgcagagccggggccgctgtgagccgagaccgcgggccgcggagctcgggcggccggcgcggagaatttgttcctgttgaagagtggctcctcttctaatttccagactccttgaggttttaggagtctggtaggtgaaattttctacctctaaggagaaacagtacctgctccttcctcaagcgcaagccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagttcaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgaggtaagaggcaacatccaggaggcagaaaggatggctgatgtct

SEQ ID NO: 12139 - DNA, 1324 bp, Homo sapiens
gtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttatgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctggga

SEQ ID NO: 12140 - DNA, 1254 bp, Homo sapiens
ggaatcagttgtttacggtatttacaggtattcaacggccttacgttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttatgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctggga

SEQ ID NO: 12141 - DNA, 1371 bp, Homo sapiens
gtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttatgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgggattcttttgaagcagttgtaattaaacacatttataagaatacaaaaa

SEQ ID NO: 12142 - DNA, 1720 bp, Homo sapiens
gtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttatgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgggattcttttgaagcagttgtaattaaacacatttataagaatacaaaaacaaaaaaaaaaaaaaaacaaaaaaacaaaaaaaaacaaaaacacaaaaacacaaacaacaacaaaacaaaataataaataaaaataacaaacaatcacagaacaaacaataacaaacaaagtaacaacaacacataaggaaatcagagagaggccgaggtgcggggcgttggctggtgccacggggtgtggacggccacgtcgtcctctctgcaccgtatgtgctgggtacgcgtgtggggcgcgcgcggcggccttacatgctcggtgtgtattgtgttccttcgcgctgcgtcgccgagcgcgcgtccttgctctcgccgggtcctcggctgcgctctgatcttttt

SEQ ID NO: 12143 - DNA, 1294 bp, Homo sapiens
gtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttatgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatacagtagggagatctccatacagtagggaga

SEQ ID NO: 12144 - DNA, 761 bp, Homo sapiens
ctactctagtcaacggtagtatgccgtttctaataagctgtaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctggga

SEQ ID NO: 12145 - DNA, 512 bp, Homo sapiens
gctctcggtacgatgaggcctgcaggcacctggcacgcaccctcctcgtcaccaggatgcccaagaagaaggtcatgaagggaccatcaaggaagagcccaagaggagattggcgcagttgtcagctaaacctgctcctgcaaaagtggaagcgaagctgaaaaaggcagcagcgaaggataaatcttcaggcaaaaatgtgcactctgtaagatctgtggttgtggtagtcctgttttcctaataacgttgttatgctgtgaaagattaaaaatttgaatatgtagtgtatatgctattcagttgtgaattggtgaaatgtatgtaacagcttatcaacatgtgaagatattgatagccccttaaggaaaatttgcttccaaattttaagctggaaagtcgctggaataactttaaaaaagaattacaatacgtggctttttagattttcggtatgtatgttaagaattgtgtacaagtttaagtgtctgtactgatccacatccaataaa

SEQ ID NO: 12146 - DNA, 1373 bp, Homo sapiens
gtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaa

SEQ ID NO: 12147 - DNA, 1870 bp, Homo sapiens
gtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaaaaaaaaaaaaaaaaaaaaaaaaaaaaaaaaaaaaaaaaaaaaaaaaaaaaaaaaaataattaaaaagaaaaataaaaatagaaaaaaaaagaataaaaagaaaaataaacaaaaaaaaacaaaaatgagggggggggcggccacctatatattttttcctgggcggaggcgcaaaaaaatattatgagcacgagccttttttgttttaaaaaggggcgcccccattatgatgggagatttttataataagaaaggagcacgtgtctttacaacaaagctggtgtgtgaggaaaaaacaaatctgttggatgtattgtggggagagaaacccatcttgtgggggtgagagaaaattatgaagccaatccataaggagaaataatgccagggggataaaataaaatgagtgatgtgtgtgtaccagtatatttctggcgagaagatgtccggggtgatttataattagcggtgatgataattagaagtgaggtagatgt

SEQ ID NO: 12148 - DNA, 701 bp, Homo sapiens
ataaagatttctatattgtagtctgatgcctccaaatagggaaatctgcatcctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaa

SEQ ID NO: 12149 - DNA, 1647 bp, Homo sapiens
cagaatcgttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcagtccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagtttactccccgattatgaagatgaggaggaggaggaagaggaggaggaaggagatggagaaagaaaaaggggggacgccagcaagccgctctccgacgcacagggcaaggagcactcagtttcctcttcacgggaggtaacaagtagtgtgctgccaaacgatttctttagtactaatcctcccaaggcccccataattcctcattcagggtcaattgagaaagcagaaatacatgaaaaagtggtggaaaggagagaaaacaccgcggaagcgttaccggaaggtttttttgacgaccctgaggtagatgcaagagtacgaaaggttgatgctccaaaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacttttccacgacagacttaactgtataatttcgttgtaaaatctgtaagttgtaaatattgtacatagttaaatctgtattctgttttgaatttttttaattaatagaaagaccaaccggcaaactttcagatgaatgcttactgtggtatttggaatgtatgtatcttctgaaccctacatcaagttgaaaaggtttgttttcttgtttctttggtttttgtatggttttttagaacacttcataaacacataagtcattgtaggtta

SEQ ID NO: 12150 - DNA, 1393 bp, Homo sapiens
cagaatcgttttgggtctggtcgccaagatggcgtcctccgcctccgcccggactccggcagggaagcgagtgataaatcaggaagaattgcggcggttaatgaaggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacttttccacgacagacttaactgtataatttcgttgtaaaatctgtaagttgtaaatattgtacatagttaaatctgtattctgttttgaatttttttaattaatagaaagaccaaccggcaaactttcagatgaatgcttactgtggtatttggaatgtatgtatcttctgaaccctacatcaagttgaaaaggtttgttttcttgtttctttggtttttgtatggttttttagaacacttcataaacacataagtcattgtaggttaatcagttctcttagtgtgctttattttaaaaacataagaaaactatatgccaaacatgaccaaaccaatgatggtcagatgtggttgcacatgagagtcacctatgaagcattaaaataattaaagtgtctgaggccttccccttcaataaatctgggattgggcccaggcaactgtgttttttaagcacccaggttattctaatatatgccagggttagagagtaactgccctaaatccagaacccatttatgtttttcaggttttttctttttctttaaataacacattccataaatttgctgtttcttgaatgaaggaaaaaatattatcttttatttatttcatccagccttaaattttgttatttggtggtaaattagggttccttgtttgcaggtcctatctattgtagaaagaatatttaagttgtctttccagcagtaacaattggctcttgctggtcattgatagtttaaatcactccttcctttagagattgaggtactcaaataggaaaagggaattagcagtgttctggagttgaaatgcatacagcatattcaaataaaagtgagcaataata

SEQ ID NO: 12151 - DNA, 2233 bp, Homo sapiens
cagaatcgttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcagtccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagtttactccccgattatgaagatgaggaggaggaggaagaggaggaggaaggagatggagaaagaaaaaggggggacgccagcaagccgctctccgacgcacagggcaaggagcactcagtttcctcttcacgggaggtaacaagtagtgtgctgccaaacgatttctttagtactaatcctcccaaggcccccataattcctcattcagggtcaattgagaaagcagaaatacatgaaaaagtggtggaaaggagagaaaacaccgcggaagcgttaccggaaggtttttttgacgaccctgaggtagatgcaagagtacgaaaggttgatgctccaaaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacttttccacgacagacttaactgtataatttcgttgtaaaatctgtaagttgtaaatattgtacatagttaaatctgtattctgttttgaatttttttaattaatagaaagaccaaccggcaaactttcagatgaatgcttactgtggtatttggaatgtatgtatcttctgaaccctacatcaagttgaaaaggtttgttttcttgtttctttggtttttgtatggttttttagaacacttcataaacacataagtcattgtaggttaatcagttctcttagtgtgctttattttaaaaacataagaaaactatatgccaaacatgaccaaaccaatgatggtcagatgtggttgcacatgagagtcacctatgaagcattaaaataattaaagtgtctgaggccttccccttcaataaatctgggattgggcccaggcaactgtgttttttaagcacccaggttattctaatatatgccagggttagagagtaactgccctaaatccagaacccatttatgtttttcaggttttttctttttctttaaataacacattccataaatttgctgtttcttgaatgaaggaaaaaatattatcttttatttatttcatccagccttaaattttgttatttggtggtaaattagggttccttgtttgcaggtcctatctattgtagaaagaatatttaagttgtctttccagcagtaacaattggctcttgctggtcattgatagtttaaatcactccttcctttagagattgaggtactcaaataggaaaagggaattagcagtgttctggagttgaaatgcatacagcatattcaaataaaagtgagcaataata

SEQ ID NO: 12152 - DNA, 1507 bp, Homo sapiens
cagaatcgttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcagtccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagtttactccccgattatgaagatgaggaggaggaggaagaggaggaggaaggagatggagaaagaaaaaggggggacgccagcaagccgctctccgacgcacagggcaaggagcactcagtttcctcttcacgggaggtaacaagtagtgtgctgccaaacgatttctttagtactaatcctcccaaggcccccataattcctcattcagggtcaattgagaaagcagaaatacatgaaaaagtggtggaaaggagagaaaacaccgcggaagcgttaccggaaggtttttttgacgaccctgaggtagatgcaagagtacgaaaggttgatgctccaaaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacttttccacgacagacttaactgtataatttcgttgtaaaatctgtaagttgtaaatattgtacatagttaaatctgtattctgttttgaatttttttaattaatagaaagaccaaccggcaaactttc

SEQ ID NO: 12153 - DNA, 340 bp, Homo sapiens
gttcacataggagattgctgaggctatgggtgtatccagatccagagttcaaaagtctggggcaagggtcttcctgttcactggcccccttatcagacatagctctaaacatacaaattactgttcaatatgctcacatgatggatcatccctagagagtcacccatttttataatataaaatgaagctataagaccttaaaagatgtttttttttaactgcatcttcattttcttggaaagaattgaaaaacagagtgaagcagaagacagtaaaatgttccatgtcatattaacttagccttgggcatcaagctagacaactttgcagcaacccatga

SEQ ID NO: 12154 - DNA, 626 bp, Homo sapiens
tgggctcatgcagtctcctgcctcagcctcccaaagcactgggattacaggcatgagccactgcacccggccctaacattgttttatagttttatcttgtgaaatgtattcccaagtattttattccttttggtgttattgtaaatggaattattttcttaattttgcttttgggtcattcactgctagtgttagaaacacaatcgatttttgtatattgatcttgtgtcctgtagcttgacaagggggtgaagcttagcacaaacgcagggctacctccaggagccataatgccacagtctctgtgccttgcccaggaacaggcttgcctgcctgagtcacaggccttttatgacaatccttcctgttgtggatcagattagaccaccatccccactccctgtatgggcacagttgccaagacacacagatgaaggggtccatgtggacaggtggctgggcgaggctgggctctcgagccatcccaggagctcgtgggcattcacctttccctctagttttgtgaatttgtcagcccggactctggcccagggggagctgggctcctccacggtggccaggagtgccccctcactgagacgggaagctccgcaggcacatctgga

SEQ ID NO: 12155 - DNA, 481 bp, Homo sapiens
attggtggtgctccctgtattggtggtgctccttgtattggtggtgctccttgtattggtggtgctccttgtattggtggtgctcctgtagcttgacaagggggtgaagcttagcacaaacgcagggctacctccaggagccataatgccacagtctctgtgccttgcccaggaacaggcttgcctgcctgagtcacaggccttttatgacaatccttcctgttgtggatcagattagaccaccatccccactccctgtatgggcacagttgccaagacacacagatgaaggggtccatgtggacaggtggctgggcgaggctgggctctcgagccatcccaggagctcgtgggcattcacctttccctctagttttgtgaatttgtcagcccggactctggcccagggggagctgggctcctccacggtggccaggagtgccccctcactgagacgggaagctccgcaggcacatctgga

SEQ ID NO: 12156 - DNA, 1041 bp, Homo sapiens
atcctgatacaatgtgagagactgcagaaggtatgaataccaggaaacagataactcagaagcatctgggaaatttgccatggaattaatgaagaaaagccctcagcacatcatccttctactctaatcaatatgaaatagcattcagtaactcctattaattcactctgaagagaaaccttttgaggacaatctgtatggtaaagctctcagctcgaattctcaccttcatgggcccagaagattatgtactgagagaatcctgaagaatggaacagctgtagaaagccttcagtgctatcagcagggattcatgtgacagctcacactaagggagaaaacctgtgaaggtctcagaaggcttcagtgacagtcatcccttaagacacactggaaatcacacaatggaacaacactcagaaatgcggaataccctgcagcaaaagtgttcacattactgagcaaactatagtgtggtattctgcagtgactatgggaaagccttgaatgttctatcggtttttaagggacttgagaattaattctggagagaatgccccattgaacatcatcaatattggagagctttctgtttttctacatttgttaggaaacttgtgagcattcacactacagagaaacttgaaatataaagaagaagagaaagccttcagtgatgcctctgtgttagggaaaatatggaacttctccctggatgcaaaacctatgagtatattaatattggaaaatttttcagtgattcttctctttcttgtatatgagagaacttatatggagaaacccctaggaatgtaatcagtgttaggatgcctcagcctgaactcttcactgagtggccacaattttcactgggaacaaaaagtataatcactgttttgagtgtgggatatcctttatcagtgtctcatctgtagattggactgctggctcattaatttttttagtctttttttcttttaatataaacatttgtgtatagctgttccctaaaataaacattaacatatttcataattttaa

SEQ ID NO: 12157 - DNA, 1254 bp, Homo sapiens
  misc_feature (1045)..(1045): n is a, c, g, or t
  misc_feature (1097)..(1098): n is a, c, g, or t
atcctgatacaatgtgagagactgcagaaggtatgaataccaggaaacagataactcagaagcatctgggaaatttgccatggaattaatgaagaaaagccctcagcacatcatccttctactctaatcaatatgaaatagcattcagtaactcctattaattcactctgaagagaaaccttttgaggacaatctgtatggtaaagctctcagctcgaattctcaccttcatgggcccagaagattatgtactgagagaatcctgaagaatggaacagctgtagaaagccttcagtgctatcagcagggattcatgtgacagctcacactaagggagaaaacctgtgaaggtctcagaaggcttcagtgacagtcatcccttaagacacactggaaatcacacaatggaacaacactcagaaatgcggaataccctgcagcaaaagtgttcacattactgagcaaactatagtgtggtattctgcagtgactatgggaaagccttgaatgttctatcggtttttaagggacttgagaattaattctggagagaatgccccattgaacatcatcaatattggagagctttctgtttttctacatttgttaggaaacttgtgagcattcacactacagagaaacttgaaatataaagaagaagagaaagccttcagtgatgcctctgtgttagggaaaatatggaacttctccctggatgcaaaacctatgagtatattaatattggaaaatttttcagtgattcttctctttcttgtatatgagagaacttatatggagaaacccctaggaatgtaatcagtgttaggatgcctcagcctgaactcttcactgagtggccacaattttcactgggaacaaaaagtataatcactgttttgagtgtgggatatcctttatcagtgtctcatctgtagattggactgctggctcattaatttttttagtctttttttcttttaatataaacatttgtgtatagctgttccctaaaataaacattaacatatttcataattttaaaaanaaaaaaaaaaaaaaaactcgagcttatgggctttctgtgtcatgtctttgtnnagcatgcctgatgttccttctttattaaatgacggagtcaggatgttgtgattacagttgaaggcgacgtgttagaaaggacaggtgcatgaaggcagagagtgcccacagactcggctctcgaaccggggcaggagggaacaaggtgagctgtgc

SEQ ID NO: 12158 - DNA, 487 bp, Homo sapiens
gcagatgttaggatatggaatgtgggatggtttctttcagagaaacgctgataatgtgatcatttgcagtgttattacttcccaattcatcaaatacagtcatgtctcaaatgagcataaaaacctagtccaaagtgatttttaaattagctgtcattttgaagtgttcttgcctttcttcctctccactagtacaattttttgtttgtttgttttggtttggttttgagacagtcttgctctgtcgcccaggctgaagtgcagcggcaccatctcggctcattgcaacttccgcctcctggattcaagcaattctcatgcctcagcctctcaagtagctgggattacaggtgcatgccaccacacctggctaaatttgtatttttagtagagatggggtttcaccatgttggccaggctgggctcaaactcctggcctcaagttatccacccaccacagcctcccatagtgctgggactatgagcc

SEQ ID NO: 12159 - DNA, 437 bp, Homo sapiens
ggccagaagtttgagaccagcctgagcaacagccagacctcatgtctgccaaaaatttaaaaatcagccgggcacggtggtgggcacctgcagttgcaactactcaggaggctgaaacaagaggattgcctgagcacaagaggtcaaggctacagtgagccatgatcatgccactgtactccagcctgggtgacagagaaagaccctttctcaaaaagaagcgtattctgctgttgttgagtggagtgtcctgttaggtcaagttggcttatagtgttatactaatcttctatatccttactcattttaattctatcaattatctattattgagagttaactccaactataattttggatttgtatatatgttcttgctttgtttcttcatgctttctcaaactctgtttttaggtgcataaacatttaggattgtt

SEQ ID NO: 12160 - DNA, 193 bp, Homo sapiens
cattggtcaaattttattccacagagatctaatgcttctatacatttggcaacttggtagctactcaagaagccatttcccaagccctgttttgtggcatttcatctaagaccagaagtggaggggagattcagcaggtcagactaccaaccaagagagaaggaggcagctgagggaatgtagaaagcataca

SEQ ID NO: 12161 - DNA, 182 bp, Homo sapiens
caaacaaaccacggttaaaggaaagattgtttttaaaaatttttttttttaaattatttttatttttaactattttttagtttttgagacaatctcgtactttcacccgggctggagttgcaatgagctgagattgcgccattgcactccagcctgggcaacaagagcaaaactctgtctca

SEQ ID NO: 12162 - DNA, 554 bp, Homo sapiens
caaactttctgaatcattcatttctctcatctagagctggtgggagattgagaggtgaatgggacatccaagatccctaaaaagaattgttcgatagcgtgcatgtgttataaagtggtgacacgggcatccctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 12163 - DNA, 383 bp, Homo sapiens
tgaagtttggttgattaatgtgtctacttgaaggatttattatgacacatgtagaataaactccttagttgggtatctcatatcgatggtaggaaggtctgagtaacagcttttgcttatccctggctcccaccattggagaagttgagctgacttatcttttggaggcagttgcaaaaattcattgccagaatggtggtcccagtcctttctccctcccaggtctgagggctcatgccaagtggggttctgattgaactagtgagcatgtattagtagaggccagcctcttgaagccaaacagattggaccatgatttcattttcatcgtcggctttaggtgttggtagaactggactttgagagggcactattccagagaa

SEQ ID NO: 12164 - DNA, 449 bp, Homo sapiens
ttgagaagtgtcccaaggatccctcagcagtggccgctcatatccactgccttggtaagttttagagttgtgctagggaggttggcaaatgggcctggacattggccaggagtaaatcatcctcacagtttaaggtttgtggatggctcagctaggaaaacatgggtttggaaactttagaagaaggaataaaggccaaactaggcaaaaagggaagggaggtagactgggcaaagggcataacacatatggaaaagaggaactattttaggatggcaccttgccaaatgcagtactgtgaagaggcttttgctgcctaaatatctaaaatgattttctgactatgcagatagcttgaaagtcttacaaaatatcacattaggttaaagagaatctaaggggatatgattatcagcccataatccttccacttgggaactgagagatca

SEQ ID NO: 12165 - DNA, 228 bp, Homo sapiens
tcccaaagtgttgggattacaggcgtgagccgctgtgcctggcctgaagtcccattctaatgggacttacttagatatactgacttttgaagattacttaagcattaatctaattgcaatttaagattaaagtatcaggacactccaaattaaagaaattctgtggtaccagtatccaaaggataaaaattccagcttatattgatcttttattaaatgaataaatcc

SEQ ID NO: 12166 - DNA, 490 bp, Homo sapiens
gtattcacttctctattagtcacaccttttacaccatagactccaaagaggcgttaagcacctggttttcctttggctcagaaaaaccaaccaccaaaaacctccgaggtgcgcggggccacgagggtcatctcctggcgcccctgagcccggggcttgcctgcaggaagagagaaagggactcggggctcccaggtccaggaaaccctcgacgaccaggaaatgggggattcccttgccacccccagccccagctggagctgctcggacggaaagcttgcgctcgatgtagcgcgggtagaagcggatcttcccacggctgtagcacgtgcttcccgtctccccgcatcttcaatgggggtctccagcaatcccccacccgccccttcagtgggtgcccgcattcccgtcccgcattccctgagggcctttcaagcggagtcgttctctgagaggaggcctcagaactcgggtgggcggggaccgcctc

SEQ ID NO: 12167 - DNA, 804 bp, Homo sapiens
  misc_feature (338)..(338): n is a, c, g, or t
gacagggtctcactctgttgcccaggctggagttcagtggcataatcagggctcactgcagcctgacctcccggccttaagtgattgtcctgcctcagcacaccccctgcacaccccctacccccgacacacacacacacaaagtagctgggactataggcatgtgccaacaagctcagcaactaattttttttttttttttaattttagtagagacgatggctcactaagttgcccatactggtctcaaactcctgagctcaaatgatcctcctgcctcagcctcccaaaagtgccgggattacaaggctcacgtaagccacggcgcttcggccgangatttttcttttgggccatcattgttgttctctgttctttcctgcaatatcaaatcagctgtcttaatttacacacaagtctaagtcaatgggccaaggagaaaattctgtgagatctgagacaatcccccacctccaatatctctctctttcccagaagttgattgggccttttttttttactctggaattttatctctttctaggatgttcatggtctcaaaaagtcaggctccgtatgagttaccattatagaattcagtttataaatgccaactacataacaggtataactaaaacatgtgctttaaaccaatattcaccaaaaaaagaaacaacaagccaagtccctattcacaaaataatctattgaaaaaaatgtttcatcatagccccttgagtttatcaacagcataagaagtttcaaggataagagagattcacaaatacgtttgctggtgtttta

SEQ ID NO: 12168 - DNA, 568 bp, Homo sapiens
tagaacatttgcattttgttttccaggctctttgctttgagtaccttgttgaatgcacgtgcccacgttacaagatttataatttgatggcttaaatgacactcaaatatgtttgtcgtttcatatagaagtacacacttggtctgtacttgccagccatattttaattcttttagcttacagctttctagaagcatgattgtaatttccagtcattttgacttgtggagaaatggggagaatgggaataacaacggtgctttgttaataatgcatattgaagtgcaaatgaacctttaaattgaaaagggaaggcatcaatgccggtcaactcagttctcaatatttctctctagaaagcactgtgatggtttttatggaagagaaagcatcctggacttaaaatgcatgtatataatgaaaatggtgcgaaaaataatttcaaatatgtggaatccttgtgaattggaattatatagtagattgttttggttagcacctacggtaaatatgaaagggacatttcctgccccacttatgctgcctttatttcactcttaaaaaaaaa

SEQ ID NO: 12169 - DNA, 543 bp, Homo sapiens
gtgccaatatgtctccatcaactgctttctctcagcccaactggccaagtccaccctctgtgttctcacttatatgggaaagtcatgcctttctcagagtctttgtcacattgaatggattctgacttattggtatactttcctccctagagggcaagctccccaatgcctcctagcttgtcttgttctgcctaaaggaaactatcacacccttagtagtcaataagtaactcctcagaaaataatgctaaaaaataaaggttctgtagcagatactgcagaagaactagacagattttcatttccaatctcactatcccatgcctatctccattctgttgaagctataaaaaccaaaagctggttttctcagcctctcctgcagccaggagtagccatataccatagttatgttgcatgaagcagaagtggaagcctgttggtgccaacacttccctttcttacttctttctgcctgcaacatggaggaggcctggggtaatgcagcattaggtgagcatgaatgggatgacaccaacattc

SEQ ID NO: 12170 - DNA, 436 bp, Homo sapiens
cccttactaatgagtgaaactaatattcttgactcagagaacttcctcaaagcctcaaaataacaacaatttgaattggtcatctaagtataaataaagttgggaagagacacctttcatgaaaggaatggttgaactaactctcaaataggaagacatcaaagtcaaggaagaaagtaagagctcacggcttggggtggaaatggttactaagtttagccatctgctttggtctttcctgttccacatgtagctatatagtttacataaaagtatctctccagaggatcagaaagaacagatttatggaaccagatgtgagttagcatttctacaggtgtggctctgcagctgaaagaacatgttgtaccagggatgaagtttcttattatgtaatcaatataaattaccactagacttttacagaggttgataa

SEQ ID NO: 12171 - DNA, 391 bp, Homo sapiens
caaccccacgaacagcccagctttcccctctggtctctccccccacccgccaccatcgaagctgggggtgtgtgtggagggtgtgcgccttgtggggtgaatttcaagaggcaccgccccttttaaaattaggtgcttggagggcggtgcctgtgcgggctggggcagaagccaggtctgttttcgaagggacacccccgccccccccgccccagttcctgccgcgggtgtcctgcccgggctgtgtccgagggaggggtttcccctgcgcttcctcttgcacttcccgctccgtttccggggggcgggaggaagattggggaagtcggctcttactcggcgacgtctctggtgccggagaccctggttgtgcccggggacggcggccgcg

SEQ ID NO: 12172 - DNA, 551 bp, Homo sapiens
tgagtggcttgcagttcctggagccctgcaggttgttggagaggcagggagcccttctccctcctgcctgccctcttgcacttcctctcccagaacccagcactactcccagaggctctgagctggagccctagaaggaggcgctgcaaggctccgtgctcctggagcttcgagtctatggtatgagttaaacagaagggtatctcctccatcagatctacaggagggtgtctgctccatcagacctggagcttccaaggcattttacccgaagctccagcacctggcccaaggctgggctgtgctgtgtcctcagtgaaagaatggatgagtcacagctgaatgactgaagagctgaaccaggtccagaaagactcagccactggagtctgtatttcctgagtcgcctctcactgctggagctgtttatcatcgctccaactttcactaaaaaggaaaaactatcacttaaacaaagccattgaaaccccagcatcatgtgtggattttttaacataaataaatcatacaaactaagatttaaattcttg

SEQ ID NO: 12173 - DNA, 559 bp, Homo sapiens
tgctgcggtcagggagaggtcgcatgctccagccagggtctttggggactcagtttagaactaatacgccaagcaagtcgtgctgagtgtctgggcttcttctaggaaggtatttccaatcatcaaatgtgccattaaaaaaaatgcatgtcagttaagtgtgcactaagcctggaccacatgggacatagtggttccaataaacacgaataagccagttttcacattagagaaataccagtttcttgcagaaatgcggtgcttttaaaagaggttaattaataaacagcaggtaattgttcgtggcacgttgtggcagagggtaattttcattttagaggatggaagggccaaatacccctccccactcagcatttttctgtaataatcacctcagcttcacctccgcctttcatttttacagctggagctgtttatcatcgctccaactttcactaaaaaggaaaaactatcacttaaacaaagccattgaaaccccagcatcatgtgtggattttttaacataaataaatcatacaaactaagatttaaattcttg

SEQ ID NO: 12174 - DNA, 756 bp, Homo sapiens
ccttccgtgtccccaaacgcccagagcccgggacacgggccggcggccgggtcaccaagccagttcccggaatcggctcgcgccggaatccagactcggcttgcaaagcccgctcctgccgtctctccgcagcgcgccctgccccccactgccggccctcttagcttcaaaaccaaattttgcctttcatcctgagagattaataccccgcaggtgaaaccgtggagacggagctgcggaggcgctgcaaggctccgtgctcctggagcttcgagtctatggtatgagttaaacagaagggtatctcctccatcagatctacaggagggtgtctgctccatcagacctggagcttccaaggcattttacccgaagctccagcacctggcccaaggctgggctgtgctgtgtcctcagtgaaagaatggatgagtcacagctgaatgactgaagagctgaaccaatgggaaaactgatgctcagaggcttgagcaacctaggccaggacctgtccttagaggcagaagcaggactcagaggaagagcaccctgaccacaaagccccagggtccagaaagactcagccactggagtctgtatttcctgagtcgcctctcactgctggagctgtttatcatcgctccaactttcactaaaaaggaaaaactatcacttaaacaaagccattgaaaccccagcatcatgtgtggattttttaacataaataaatcatacaaactaagatttaaattcttg

SEQ ID NO: 12175 - DNA, 764 bp, Homo sapiens
ccttccgtgtccccaaacgcccagagcccgggacacgggccggcggccgggtcaccaagccagttcccggaatcggctcgcgccggaatccagactcggcttgcaaagcccgctcctgccgtctctccgcagcgcgccctgccccccactgccggccctcttagcttcaaaaccaaattttgcctttcatcctgagagattaataccccgcaggtgaaaccgtggagacggagctgcggaggcgctgcaaggctccgtgctcctggagcttcgagtctatggtatgagttaaacagaagggtatctcctccatcagatctacaggagggtgtctgctccatcagacctggagcttccaaggcattttacccgaagctccagcacctggcccaaggctgggctgtgctgtgtcctcagtgaaagaatggatgagtcacagctgaatgactgaagagctgaaccagtaggtttccctggggtttccacaggcagtttcagcccaggggaagacccagggagatgagggccaccttgcaggacgctgtggtgtggaggcagcagcctggggcagggactgtgctgagtgtctgaggccgagccacccctctgtaacctctataatccatcaggtctcagagggccgtcctatgttcagtaagccaatgctagcaccatgtgacgaggacacagcagtgagcagctgcccaggccccttgcactgtgtttggaaaaggaagctggcttgttcaggggtccccagcagg

SEQ ID NO: 12176 - DNA, 363 bp, Homo sapiens
ggggccagctggtctcctggcaactgaagtccgcgcttcccttccgttcactcattccttcctttcctcatgcaggaggcgctgcaaggctccgtgctcctggagcttcgagtctatggtatgagttaaacagaagggtatctcctccatcagatctacaggagggtgtctgctccatcagacctggagcttccaaggcattttacccgaagctccagcacctggcccaaggctgggctgtgctgtgtcctcagtgaaagaatggatgagtcacagctgaatgactgaagagctgaaccagtaggtttccctggggtttccacaggcagtttcagcccaggggaagacccagggagatgaggg

SEQ ID NO: 12177 - DNA, 436 bp, Homo sapiens
ggagccttgataaactcaccaaaacacttcaaacacaagcaggagatatcaaagagggctcaagctacctatacaccctggatgactgtgaaatctgcacatatgcagagaagatgcaaaaaggcctggcagaaagtaaatgccagggcagacttgaaaactgcctgagtttttaatgggctcccccaacccaaccacagacccatgggcagagggtaaaagctttactagcttagggtatttgagcataaccaccgactaattactggctgaccactaagctatgcagacatgggagtgacccctaagaatcaggcttaaaaataaaaacaaaaataagttttaaaaaattaagtagagagataagcagcgatgcaccatgaaggagatggattccacagatttagtttaggcaacttaataaacaaaaaaagaa

SEQ ID NO: 12178 - DNA, 449 bp, Homo sapiens
gcaaatcccttatctgagagactaatcacttgtgatatttgaccattcttagacatggcaagggcatagatagctttgccttgcctgcagcctctcctgcagagtcatctggtttctctgtcttatccagagagtgcttctattaggcaaagactgaagtctaccaaaaagctccttgcaatgtagagctacaccattgatcttcgtggaagcatttgggatcatgatgtgattgataatgtgggaagggttcattaagaaagatcagggtacacgtgagtaaaagagagcttcagaaggggtgaaaaataagagtgtcttaggccgtctcaagtgactctttgccctcattcagataagatactgatacctccatattaccaatgaggttactgccttctcaagaggtgagatgacttttcctaggtcacatacaaaatgaataaatg

SEQ ID NO: 12179 - DNA, 429 bp, Homo sapiens
gtatagtactatgaaattccactgcaagtattgatttccataaatatcaccaagataaagacacagaagtgtttcattcccacaaagaaactccctcgtacgatccttccttttattgtcagactctgcccccattctgaatccctagtgatcactggtcacttctccattgctataattttgtcatttcaagagtgttatataaatgaatccataccagatacaactttttgagataggcttctggtatccagcatactgccctagaaattcatagaagttgttttatgtaacaatctggctgaatagtgtatcatttatggatataccacagtgtatatattggcccattgaagggtatttaggttgtttctatttcttggctgtccaaataaagttgccatgaatatttatgtacaggtttttgtg

SEQ ID NO: 12180 - DNA, 379 bp, Homo sapiens
ggctgtggtccaatgccatttttgccggctataagcaggatctctggaaccaaagggagcacacacctcttctaaaaattgaagttgtttatgcctgagatgaaacagaattctatttgggcaagagatgtgcttatgtatacaaagcaaagaacaacccagtgactcctggcagcaaaccaaacaaaaccagagtaatcgggggaaaggtaactcatgctcatggaaacagtggcctggttcgtgccaaattccgaagtaatcttcctgctaaggctattggacacagaatccgagtgatgctgtacccctcaaggatctaaactaacgaaaagtcaataaataaacttggatttatgctcttgaaaaaaaaaatcat

SEQ ID NO: 12181 - DNA, 1559 bp, Homo sapiens
ttggcattttcaagaaggatggttatttttagttctggttatttggtgttggaggtctgtgacacttccttatacatttaaagccccctttgaatagttgtatcaatagttcaaaagcctgtagatatcttgcttttctattctgacagcccagcttctgcagactcaggccaaccttaggtatgtcacatcagttccccatctgtgtaaattacctgaacctctctgtggtattcactgagagttgagcttctactaagggatttccttgacctggggcttttaacaccagatttgtagtgggagtgtttattagtaaaggcaaagggagtaagtcaggagatgctagcccctgctctcagttaaacagaactatcctccttcctgaatatttaaacataaaattaattttaaactactataaaaatcatgttccattgcttgccaaatcttataccattataatgctgtatttttacatgttagtatacattgtgtccatagggatataaatatgagaatttcagcaactgtcttgcagggttaagatgtgctatttgttgattttgcaaatttttctcatgtggtacagtccctccaaagaaaatttccttagacctaaatggtagcataataatttctcctccatatccgtgactaacaagttcctgaaaacagaagtagacatattttatgcccaatttagtacctaataattgaggcttaaaacaaaattttcttgggcaagttgggtgattaaatatgaattaaaacttctagagaaagatttccagatgcccctgtttccatttgattatggttttagtttcatagcaacttgggggaaaaaaatcatttactttatgtcgtattacaacaacaactttgacagcttaaatgtagtgacctctctgaaggtaatatgcacattataatttaggatgaaagcagatttaaactaagactttctgagatgaaataaaagtaaccaattcataatagtcatgtttattgcagcaatatcttgggaacttaagtttagtggcgtttgaggtgtttctgaccatcttgcttgttcatttcaccctgctctgcagagacagaatatgattgaatgaactgcccattatattaatgaccagttcaaagcagttttgtgctttggctatagataaaatttggcaaaaatactgtaggcctttctggtccatatttatccttaaagtatttttgcccaatcaataaaaatgaaatatttatccagaaatagaaaaagctctttcctatgacattgacatagaagcccaaatactccttgtttgagaccctgcatgtcttttgtgtttaactgaatcaatgattttttttagttgtgctcttaattgcattatttcacatatgtaacactgggtttgttttggttatatagtattattttactttattctaatttcaactcatgtcactctgtagctcattaagaatttgttcaactgaaaattaaaatgtgtgttaaagcaataaaaatgaaaagattggctatgcattttaaaaaaaaa

SEQ ID NO: 12182 - DNA, 390 bp, Homo sapiens
  misc_feature (333)..(333): n is a, c, g, or t
  misc_feature (340)..(340): n is a, c, g, or t
  misc_feature (353)..(353): n is a, c, g, or t
  misc_feature (361)..(361): n is a, c, g, or t
actgcctcatagtaagtgaatataaatggcatttaaaaagaatattcctggcaatatttattttcgagctatttgaaagtatatttagaaggattattttttttattgttaaaaagatgatagaacaacagtattaaagaagagtttaaaaatagttatccatattatcaatattttaaaataatgtttgtttgcttaatatcttgtaatttcaatttacctgcatgcatattttatgtaactgagatcataattacataggcaagcttgctaggggaatggggttggggcatagtgggtcaccaatatagccccatgggagaggagggggcnggagccnggtccttttcccnccaggggngggagggggggtgccttaggccggcctgg

SEQ ID NO: 12183 - DNA, 433 bp, Homo sapiens
acagaaaaaaaaagtgcaacctctctgaatatctgaatcaatacccctttactctttgtacagcagcctctgactgaataaataagtactttttgtatagtggcctctctggcccacaggctggtgagatctaggagtccagagtcagagttgggtccctccggatctgtggagacattttcccttcatgatccttctcaccatcttctcgctctctgttttgacccacacgtggtatggaagaactgagggagctctgagcttggtttgcaagtgtgcttgggagattgttagggtacacaaccccaaattctcatatctttgtatttcatttgttcttttcaagttgagttgagtatcctaggaggaaaggagatgggaggcaggctgaagaattccaaataagtaccatgctttttatgaaaagaacctt

SEQ ID NO: 12184 - DNA, 604 bp, Homo sapiens
cacacctggctacatttttaaaattttttgtagagatgaaatctcactgtgttgcccagggtggtctcaaactcctgggctcgagtgattctcctgcctcagccttctgagtagctggggttacaggtgtgagccatcacacccagccgaaaagtatttctagtagtcaatatgtattagatttctgataagcaaactcccaataactaacacgatgggactttcaagggaaatgatagagatttccactgtttccatgttttgggaggccgtggggaggccatgctcagattgtggtgtggtcagaaacgtgcctgggggccaggcacagtggctcatgcctgtaatcctagcacttggggaggccgaggcaggtagattgcctgagctcaggagttcaagaccacgctgggcaacgtggtgaaaccccatctctactaaaaaaattcaaaaattagccaagtgtgatggtaggcacctgtagtcccagctactcgggaggctaaggcaggagaattgcttgaacccagaaggtggaggttgcagtgagccgagattgcgccactgcactccatcctaggtgacagagtgagactctgtctcc

SEQ ID NO: 12185 - DNA, 410 bp, Homo sapiens
cacttttcgggggcctgacgtctcgaaacgcatttagattgatgcaggctggggctgacgttctcgtgctgagtaaacagtcaagtgttcttaataggaattgcagtttctcgacatctgttagggaaaagggaatggcgaaacaacaatttagagtgagattggttttgttaaatgcatttaaattccaagattagtggtgttctttctttttcaattagcatttacttgtagaaaggttacagatgaaagggctggggaagagatcgggtggatttttttccttactgagaggacactccaaagcatagtaaagctaaaataggaagagaacgtaagacttaaaggaacttaaaactgatgccaaattgagattgcaaatcttgaagggaaagcatttaaaataaaat

SEQ ID NO: 12186 - DNA, 2724 bp, Homo sapiens
atctgcaagggggaaacaggattttggcagcaatcctttcattactaaagcttcctttcttttcgggtacagtgaaaagagccaaggctgtgtgaccccctcatcacttagccaggcgtatggtcctggtttctgaggctgccagaaagcatcttagcaatttgtgtttggaaggtccatgcctgactattctaggctggaggttcctaaagagtaacaagaggaagagaaacaagaatctctgacacttgttgagaatagagcacagtcccatttgtttgaaaagagacaccaggcagccatgtttatgtgccagaaatgcattccacctcaaggaggacttaatttatggacccgtgtgtgccaggctgagctgggcaagatctttctcaggacaaactctgccatgcagctaaaagcctggaaactaaaggatttcatgtagtaaactatcttccaacccctgtaggcatcagaccacaggatgaggtttcagaaggtcataaggcagaatagttaagcctacagggcttacagtctgacagacctgggttcagttcttgggtcttcatcactagttttgtgacttcgggaagatgactcccggagcctcagtgagcctcagttacttcatatgtaaatgaagtaatactatctacttcacaaggctgttgaaaggattaaatggagaatgggtgtaaaacccttagtgcagtgccgtgcacacaccgtagatgccgaacgtgtgatgttggcactacacaatgtgtaatcccaatcaggcagagctaggcaggcaaatctaatccaggatctttgtaaggggactgagaaccagagactggagaaagccagtgtaaacaccatgagcaaaggagcaagagaaggggcattgtgtaagtaggagatggagcttggacttactaagtggatcagggtagaagaatccagtcaggaccaagggaggagagtccaggaaaatgccatgagcagctctgtagcatgaccttgttgggctgggttaaagtagggtctgccaccagtcatgtgacagaaaggtacctcatgcacttcctccttcccccagaaatcagcctccaggagtgaggaatgagcccagaatgagagtttagagtgctccagagcctttgttagaggtgccctccgacattcagaaaaccaggattccagagacctgggtttgagtcctgactttgcagcatactaactgtgtgatcttgaaccaacatattttcacctaatgaggctgacaatcttccctacttcacaaaatagttatgagagtcaaataaaagtacattttagaaagtgaaatgctgtggacatttaaggtggagccactgtgagagtctagggggatagatggtagtcgtctcagaatgaaacgaatacacccctctcagagccctttccaaggatcccctccttctttcagctccttccctccacctcaatacacactcctgtcccaggaacctaacctcatctagaaataccagggccagcatgccttacacctagaggtttggttggcttcagagaaacttctggaggctaaaagcagccaagaagaatcagccactacatgctgggcctggatgaacagagcagtgagctgtgatggggctggggctggggcccaggaggagcaggcaggagagtttgtatgcaccgtgattcaaatattataacaaaaatcatcgatcatgtgttaggcactttacagttcccaaagcactttcccatccatgccctgatgatctttgacacaacactgtgatgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcacgtctctcctcatcagattctaactaagcagatgttctcatgcttttttcttcttcctatgttctgtatactgacacctcttctcagtggcatatgaaatatgaaatgtcatgtgttgtgagtttgtataaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtgaaaaaaaaaa

SEQ ID NO: 12187 - DNA, 1558 bp, Homo sapiens
cactatcgtgagtgtatctcatcttccaaatgttttgcctgtctgacttataatgcaagctttcagcggtgggagcagaatcagctatgttcagtactctactggtactcaacaataagatgaaggaaaagaagaggaagaagaaggaggaggaggagaacaagaagaagaaaaggaagaagaagaggaggaggaagaagaaataatgaagcaaggatatcagatttatagggcactattacaccaagaaatattcatattatgggtgttccagaggcagaagacatgggaaaaggtgagaaaaacacatttaataaaagaatagcagaaaacttcgcaagttttgagagaaaggtggacatccaggtctaggaagctcaaagaattccaaatagattcaacccaaacaggtcctctccaaggtacataacagtccaattgtcaacagtcaaagacaaagaattctaaaatcagcaagtgaaaagtgtcaagtcaaacttaagggaatccccattagactaagagcagatttctctacacaaacattacaggccaagagagaatggggcaagatattgaaagtactgggaaaaaacccctgtcaactaggaatattatactcagcaaagctatctccttcagaaataaaggagaaataaagtcccagacaagcaaaacataagggaattcactatcactaacctgattttataagaaatgctcaagggagccttgcatctgaaagtgaaaagataataatgtgaacccaaaatatctgagacaggtcgcagtcaatttagaaagtttattttgccaaggttaaggatgcacccatgacacagcctcaggtggtcctgaggcttggacatgtgcccaaggtggttggggaatagcttgcttttatgcatttcagggagacatgagacacttcaggacaacttgaagtgggggcttccaggtcagaagtagataagagacaaaaggttgcattcttttaagtcctcgatcagctttccactgaatacacaatttagtctggcttggtgcatctgcattgttacataaagaataagacagaggaaacaatcagatatccatttgtctcaggtcaacctcagagggatgactttgaattctgtcctttgcccacaaggaatttccttgagacaaggaaattccaagtctcaaaacactaaaacatcaaaattatgtcaaatatcttatgtgaccacagtggaataaactagacatcaattacaagaggaacatttaaaactatgcaaatacatgggagttagaaaacatgcttctgaatgaccaatgagtgaaggaataaattaggaagggaatttaaaaattccttgaaacaaatgaaaatagaaacacaacataccaaaacctatggggcacagcaaaagaagtgttaaatggcaaatttatagcaatcaatgcctacatgaagacactagaaatatttcaaataaacagcctgatgatgcacaaagatacaaatctaccaaaagaagaaaaaaccaaatccaaaattagtaaaaaaaaa

SEQ ID NO: 12188 - DNA, 5352 bp, Homo sapiens
gcgagacgccctctctcttccagccgcagccgcgttgcgggttcttccctgtggaacagtagagacctagtctgccttctttcacaagataatccttcaattatttgaaggtgattattcagcatatatctcttgagtacctgtgcatgcaagacactgtcctggatattgtgagagatccaaagtttagtatgagatcattttcccttgcctgagttttgagctgattgagaaataagaacctacagatgaagaagcaagacagtacctttaaaaaaattagctttttattcagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgcgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12189 - DNA, 4468 bp, Homo sapiens
  misc_feature (573)..(573): n is a, c, g, or t
gggaaaatacagatttgtgtggcatttcctatctgttcatttattggtactgtaatgtaaagagcagtatcaagtttgatattactaggtgatgtggcaatttggaaactgctagactggaggttagaagacctgggttcaagtcttagattcatcatgataaccttgctaagttatgtcacttctctggttcagtttcttttatttgtaaaatggagagaaataatacctttctgcctgtctcacagagcagattgcccaacacgtgatataatgggtacaaatccccttgtaagacgggacaagaatcagccaatttcaggaataagggcagctcatcgttttcccttaccacacttcaccctttcaccatccaggaattacactgttgtcaatattttataggtgtttcaaatgattggtatgcgacacttgatatgctaaaagaaagctgtcgaattgccagcagtgttaattggtcagatgtagacctttcacagtttcaaggtgagtgttggttctttttgacatataaccaaatacacatgatcctgtttctctgctagattatanctttctttgtagtagaaataaacatcatcttatatagcatttcttttgcagttggtaaaattcataataattttggccacttggtatagcagagggtcacagacaagttctgaaagaaatttgaccacatttaaaataattgggctttgaataatttaaaaaggtcattcttcattgcgtggataaatcactaccataaagtggagtgagtggaaattttgagagctgaaaaaaattatgtcttgctattttccttgcaatgtttattgcataacagtgctaacatatttttaatgctttcctcataggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12190 - DNA, 843 bp, Homo sapiens
cggacgcgtgggtcgacccacgcgtccgcactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12191 - DNA, 2670 bp, Homo sapiens
  misc_feature (335)..(335): n is a, c, g, or t
tacactggaatgtaattaagtgtgaaattatagggcagattatcagtgctaatagtttagagaaagaatcagtgaagactgacgtagaagtaaattccaaagttcactcgtcgaccaaactacccttctaaacgctccacctactgatagtagtaccataacctgggtagctaccttgagaattagaagggcctttagaggtccaactcctttaaaaagaaagaaagaccaggcacgggaaaggcctccgcagacatgagtctagcacctgggactcatgaagttctgaaaagaggggtgtcctgaaggtccaaggcgcctttgttgggggtccnggaatccgcggtgtgccaggtcggaaaaggcgtccgctttcctggagaggaggctaaggtgccgggcgcttcgattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaatt

SEQ ID NO: 12192 - DNA, 517 bp, Homo sapiens
  misc_feature (335)..(335): n is a, c, g, or t
tacactggaatgtaattaagtgtgaaattatagggcagattatcagtgctaatagtttagagaaagaatcagtgaagactgacgtagaagtaaattccaaagttcactcgtcgaccaaactacccttctaaacgctccacctactgatagtagtaccataacctgggtagctaccttgagaattagaagggcctttagaggtccaactcctttaaaaagaaagaaagaccaggcacgggaaaggcctccgcagacatgagtctagcacctgggactcatgaagttctgaaaagaggggtgtcctgaaggtccaaggcgcctttgttgggggtccnggaatccgcggtgtgccaggtcggaaaaggcgtccgctttcctggagaggaggctaaggtgccgggcgcttcggtgaggtggcggatgttggggggcgggggagggcagaaggcaccattccttcggggcatggggccccaggtatccgtgggcagggtccaaagccaccgatccctactgt

SEQ ID NO: 12193 - DNA, 5121 bp, Homo sapiens
  misc_feature (3)..(4): n is a, c, g, or t
  misc_feature (7)..(7): n is a, c, g, or t
ggnncgnggcccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgcgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12194 - DNA, 5140 bp, Homo sapiens
gcgagacgccctctctcttccagccgcagccgcgttgcgggttcttccctgtggaacagtagagacctagtctgccttctttcacaagataatccttcaattatttgaaggtgattattcagcatatatctcttgagtacctgtgcatgcaagacactgtcctggatattgtgagagatccaaagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgcgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12195 - DNA, 4666 bp, Homo sapiens
ccaccggcagttgtactccggcctgcgcagcctgagattctctttgtggccagatgggtttgtatggacaggcttgtccatctgtaacttcattaagaattccatacgacataatctgtcattgaacaaatgtttccttaaagtgcctcgatctaaggatgaccctggaaaggggtcctactgggcaatagacaccaatccgaaggaagatgcgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12196 - DNA, 4662 bp, Homo sapiens
agtagaagagatttcactagtgatttaaattcattttcagaaacaaagcacaaaactggatgttcaagaatttgatgagatcccttcaaactgtgttaaagttgctggatatatgagctaataattatttattttgttcttgtattttaggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12197 - DNA, 4466 bp, Homo sapiens
  misc_feature (1)..(1): n is a, c, g, or t
nggtggtctagaggatcccatctcaggccaggacgagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12198 - DNA, 4219 bp, Homo sapiens
ataaaggctccgaaatgaggcactaagatcttcaaaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12199 - DNA, 5329 bp, Homo sapiens
  misc_feature (3)..(4): n is a, c, g, or t
  misc_feature (7)..(7): n is a, c, g, or t
ggnncgnggcccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgcgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaacaaaaaaaacaccaccacacacaacaccacacaacctcaccacaaaacaaaaccaccacacaaccgcacacaaaaagaacaacaggccacacgcagcgaacaacaaaaaaaagagagaagaagacacgaacacgagcggcggggccggcagcaaggagaggcagacgagacagggcgggggggtaggagcggaagcagggctcggcggat

SEQ ID NO: 12200 - DNA, 5016 bp, Homo sapiens
  misc_feature (1121)..(1121): n is a, c, g, or t
gcgagacgccctctctcttccagccgcagccgcgttgcgggttcttccctgtggaacagtagagacctagtctgccttctttcacaagataatccttcaattatttgaaggtgattattcagcatatatctcttgagtacctgtgcatgcaagacactgtcctggatattgtgagagatccaaagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagatttcctatctgttcatttattggtactgtaatgtaaagagcagtatcaagtttgatattactaggtgatgtggcaatttggaaactgctagactggaggttagaagacctgggttcaagtcttagattcatcatgataaccttgctaagttatgtcacttctctggttcagtttcttttatttgtaaaatggagagaaataatacctttctgcctgtctcacagagcagattgcccaacacgtgatataatgggtacaaatccccttgtaagacgggacaagaatcagccaatttcaggaataagggcagctcatcgttttcccttaccacacttcaccctttcaccatccaggaattacactgttgtcaatattttataggtgtttcaaatgattggtatgcgacacttgatatgctaaaagaaagctgtcgaattgccagcagtgttaattggtcagatgtagacctttcacagtttcaaggtgagtgttggttctttttgacatataaccaaatacacatgatcctgtttctctgctagattatanctttctttgtagtagaaataaacatcatcttatatagcatttcttttgcagttggtaaaattcataataattttggccacttggtatagcagagggtcacagacaagttctgaaagaaatttgaccacatttaaaataattgggctttgaataatttaaaaaggtcattcttcattgcgtggataaatcactaccataaagtggagtgagtggaaattttgagagctgaaaaaaattatgtcttgctattttccttgcaatgtttattgcataacagtgctaacatatttttaatgctttcctcataggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12201 - DNA, 3417 bp, Homo sapiens
gtctactgaccccctcccccacagtgagataatgtgtgcctggcatataggaagtacacagtaggggttagtttatttcttactttcttctctacccaagtcgctgctattattgcctctttccttccaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12202 - DNA, 3575 bp, Homo sapiens
tgttcaaaaggccaagaccacaattttagcatctgaaaggagtaatattttcttccccctttctccttattttacctgcttaatttactttcagagtaacaattctgttaagattttagtgctccatttgttttatttgtggtaacatgttttccctctttctgcttttaatctgattaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccaaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12203 - DNA, 1805 bp, Homo sapiens
gggacaacagaggatcccagacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctgtggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12204 - DNA, 1207 bp, Homo sapiens
atcccaactctgcatgatgacgtagaacaaagagtaagaggcggggtggggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12205 - DNA, 969 bp, Homo sapiens
tgcctgtgttgggttgacagtgagggtaataatgaatagtttatgctgtaatagtttatgctgtaatagtttatgctgtaatagtttatgctgtaatagtttatgctgtaatagtttatgcacagcataaactattgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12206 - DNA, 566 bp, Homo sapiens
  misc_feature (18)..(18): n is a, c, g, or t
gtaccccgcccaattaanctcactaaagtcgttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12207 - DNA, 513 bp, Homo sapiens
agctcggtaacaggctcatttcagtttaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 12208 - DNA, 1238 bp, Homo sapiens
  misc_feature (3)..(4): n is a, c, g, or t
  misc_feature (7)..(7): n is a, c, g, or t
ggnncgnggcccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgcgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccaggcagcatatgctattgaacttctaactagggatag

SEQ ID NO: 12209 - DNA, 838 bp, Homo sapiens
gcgagacgccctctctcttccagccgcagccgcgttgcgggttcttccctgtggaacagtagagacctagtctgccttctttcacaagataatccttcaattatttgaaggtgattattcagcatatatctcttgagtacctgtgcatgcaagacactgtcctggatattgtgagagatccaaagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggtaggattcatcttcttaaaacagttgaattcttcagtatgtcacttgtcatgtttgaattaagaacttttccagttcattgaataggaacctctgcaaaatagtaagtcctcccccaccctgctctaaagcttgttagagagttttaagctgtgggaacctaactagtgtatagctgttgcacaccacagt

SEQ ID NO: 12210 - DNA, 445 bp, Homo sapiens
atcattatcctgtttaccattctcatgggagccaattcatgttactgaaacaacgtattggagcaaaacagactgtaagagcagtggctacattggcacttttctcgtgtcttccttactgcagcctggtataatggaaggagtgtggatcaagtgaactgacctcagatcctatctttgtcccctactggttgtgtgactttgggtaatttactcatcctcttaaaccgtatccccttacctataaaataaggatcataagagccactttttgaaggcttatggttgaattagtgagataatgtgtgcctggcatataggaagtacacagtaggggttagtttatttcttactttcttctctacccaagtcgctgctattattgcctctttccttccaggccatcacagagccatgaaccagcagcacatgatgccttcccaag

SEQ ID NO: 12211 - DNA, 381 bp, Homo sapiens
agtgttgcttcctggcatcatatgcttttgttatgttaataattttacaaatgtttgtcataaaatacaactgaaatctgaccataaatgatcttgctttgtttttaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccac

SEQ ID NO: 12212 - DNA, 355 bp, Homo sapiens
gcttcaaggcattattctttctgatcagtttcaaacatttcaaatgattcttataaagaagggtaggagtggggtggatctatgtaacgaatgctttttttttttggtcttagttcaggctgctatagcagaagactgagtggctaataaataacagaaatgtattctccacagttctggaggctggaaagtccaagataagggtgtcagcatggccagattctgtgaatatttgaagagaaaacgaagaggttattaaatgtgtttgggaatatcataattataataggtaagcaatattcatgttgttactattgtgtcttttcctttgtaattattaggaaagctagtggaa

SEQ ID NO: 12213 - DNA, 1194 bp, Homo sapiens
ggtgcaatactgtccacaggtaagataattaaattagctttgtttttaaaagaaaaatcttactagattcttatacaaagtgtggcaaatataaaacttgcttgaaaatacagaaattaaatttttaagagagttaatggtaagtaaacaattttaaagttaattttctatgatatacttacagcacaacttatatttccatgcagaatcttttatttttaagtgtgagtgttaaaggttacaaaataatgaaatgacttcagtggatttaaaattttgaaaaataatgtcttttctatattgattttacaatttggagaaatttttcactcattttttatatattttttagtgggagaggtttagtctacagtttttatttttagtcaccaaactgtagccaactcttgggtcattttctctgaaaaacatttggagatcatgacagcgtttggattaaaacatttctgttactttgcatgcaaactagtttactgtgttcacagagtggccagtcatgggaccataagcaacacctgctctttgagtgtctttcataccgttaccatcagcaccagaaactccaggtgccccaagcttaaagtaaaaatcctaaagtacgttggctcctcccatgcaatgtgctgggtccaaaccatgctgttaaatatcagaagtttctatggttatgattaaaaaattaaatgacaataatagccccaaaactatatatttttgatactatttaaccaagattatcacaaagacacagtatttgacacattgttattcttctatgttttataaatattttaatgtgacaggtagaatctgtactttttctgtagaacgtaatattttgaagtatatatatagttaaattattatttctaggtaattaataatttatctcacattggtcagacatgatggctcatgcttgtaatcccagcaatttgggaggccgaggcaggcagatcacatgaggtcaggagttcgggaccagcctggcgaccatggggaaaccctgtctctactaaaaatacaaaataagcagcgtgtggtgacacatgcctgtaatccagctaccctggaggctaaggcaggaaaatggctcaaatctgggaggtggttgttgcagggagccgagattgcaccactgcactccagactgggggacagagtgactatcaa

SEQ ID NO: 12214 - DNA, 436 bp, Homo sapiens
gtcgtccctggctgttggggaggactttgtctgtctgactgccgctgggctgccttgccccagctccctggggtcctttgctccgtaatccatcagctcttcttttctcttcttcttactcatagtataagacccgactgcccattttttggagatgactaattaattagtaaaatatttggctgggcgcggtggctcacgtctgaaatcccagcactttgggatgcagaggcaggcagatggcttgagttcaggaagttggagaccagcctaggcaacatggtgaaaccctgtctctaccaaaaatacaaaaacttagccaggtgtggtggggcgtgcctgtagtcccagccacttaggaggctgaggcacaagaattgcttgaacccgggaggtggaggttgtagtgagccaagatcgtgcagctgcactccag

SEQ ID NO: 12215 - DNA, 894 bp, Homo sapiens
gaaagaagtcacacatacagtaaaaataattagagaggacctagttcatattgagcaatcttccccaaaccctgaaacaggtcttctttctaacaccagaggtatcttgagtgagtccaacccctgcagtcccctctgtctggaatagatggaggaagtttgctccagccttagaacagcatgggctggcaagcgttctcagagaggtctcgacttcaactctaaagggcctgaggaatatgtgcaactgggtcgggttaaggccaagctgaatcacatgaccagggctctcaccagcgccaaagtcagtggaaggatatcagtccccagagctctgtcacaggccatggatgctccatggaggggtggtgagcatatgaataagaatcaggagaaacatcggtaatggacaggaggcataaataaacaatgtccaccgtcctctaaaacccaggaaagttctcattcaaaagacgatgtcttgaaggaaacataggtacaaatctttgtgactttggattagacattttttaagtaggcacaaacaacccgaaaaatagataaatggacttcattaaaattaaaaacttatatgcttcaaaggacactgtcaaggaagtgaaaagataatccacataatgggagaactatttccaaattatatgtttgacacaggtctagtacctagagtatataaggaattcatataactgagcaataaacgacaaccacatttaacaatggggaaaaaagctgtgagtagaggtttctctaaaggaaacactcaaatggccaagaagcacatgcaaagatgttcaatgtttttcgtcattaggaaaatgtaaatttaaaccaaaatgagataccacttcacacccagcagtatgacttaag

SEQ ID NO: 12216 - DNA, 865 bp, Homo sapiens
cagcatcatatttaaaaaatggacagagatagaaacatagttacagatttaaaaggttctgttgaatattatgcttttttctaatatgtttgaaaatttaaacaaaatggtttttaaggaaaatatacatcaatattgactccaagaaaattaggactcttcaaagactctcataaacacagagaacagggaaaaattagcatgtgatcagttaactattactaatgaagcaccaaatccagtttctttctaaggaaaactttatcaaatgttcaaggaactatttcagttatatagaagtacacatccttggctcacgcctgtaatcccagcactttgggaggctgagatggaaggatcatttgaggccaggagcttgagaccagcctggccaacatgttgaaaccccatttttactcaaaaatacaaaacttagccaggcatggtggcacatgcctgtaatcccagctactggggaggctgaggcaggagaatcacttgaatgcaggaggtggaggttgcagtgagccaagatcacgccatggcacttcagcctgagcgacagaatgagactattaaaaaaaaaaaaaaaaagtccacagtgtagctttgtttggggttaagttagtgttttgaaatgggccttccctgtgctcaaaacatgctcagcaagcagctccccacgctggacagatcgcatatgtggaaggatgaagtttatgtctgtagaactgttattttatgccccacttccttttttcttagatcctgtgtagacgggtctctctgaacattgtgttactttactttactggcataaggaagtaaaatatttcataataaatttgagaaaagtagagtgagc

SEQ ID NO: 12217 - DNA, 450 bp, Homo sapiens
ccatcaaccctaaatttattatgtgggcttatttgagggcactgtaatcccagctactggggaggctgaggcaggagaatcacttgaatgcaggaggtggaggttgcagtgagccaagatcacgccatggcacttcagcctgagcgacagaatgagactattaaaaaaaaaaaaaaaaagtccacagtgtagctttgtttggggttaagttagtgttttgaaatgggccttccctgtgctcaaaacatgctcagcaagcagctccccacgctggacagatcgcatatgtggaaggatgaagtttatgtctgtagaactgttattttatgccccacttccttttttcttagatcctgtgtagacgggtctctctgaacattgtgttactttactttactggcataaggaagtaaaatatttcataataaatttgagaaaagtagagtgagc

SEQ ID NO: 12218 - DNA, 399 bp, Homo sapiens
cgcctgaggcagctgctactccgtgtctctcacagcgtctgtctcccgagtcctcagttgccaatggatgtggcagcccaccccgcaatctgcacagatccccacaccagtgagacaacacagagtccactgtagctgtctccaatacttgaatttttccaaggggaatgatccttccctgaatcatggcttccaagattccctgcccgccttggatcccaagcctcgaaggggaattctgagagctacctgctgctgactttggcttaaggggaggctgtttggtagaaaacaaagagagacagtggagagaggcaagctgggctcaaaggcaggacttatcatcaggcctgtcatcatccctgtggtgttggctacaaattagggagatggcatctg

SEQ ID NO: 12219 - DNA, 303 bp, Homo sapiens
tttttttttgagacagggtttagctgggtcacccaggctggaatgcagaggtgtaggcatggctcactgcagcctggagctcccaggctcaaatgatcctcctgcctcaataccctgagtagctgggacgacaggcactgccaccacgcccagctaaaaacatgaatttcaaagctatataaacctttgctatttcataacttaggtccactaagagaaaagcaagctaaaaatagggccaagggaagaatgtcatcatattcactttgcaaactatgagaaccaatacaaatagcaagacac

SEQ ID NO: 12220 - DNA, 683 bp, Homo sapiens
tgatggtggaacatttaaatgcagctacttgtagcttttggaagtgacgggtggatctgcagtggggaagaagaacgccaggaaagacaagtgaggtttctgggtctctgcaagaataatttccagacacaagccctcccaggttcagtgtcgggaaatgaaagcagcatatgcaaaatgcacggcagaactgaatttccaattcactacagacatgctttggaaaacatgaaagagctatttttggtccagtgatcgattagggttgctatggcaataagaaacacttacaggaacaaaatgaaatgtaagcaaaccaaagtcttaaagagaaagggtcagacacattggggatttcatagtcagtttctgggtggtgctggcagcccttatttctgtctcagcacctgcatagggagagagacgatagtggctgcagtgaatgggggccctggggatgggtctgaggctctctagggcactgcacttcagaagcaggaagtgcgaaacttctggaagaatgtacaccgctcactttgaagactgtcattattgtcatcaaaggatactgtatttccacagcacctagcctgtggcaaaaacgtaagctaaaatgtattaatcctaccctatcccactttacaatgtaaaagaaaaataaaagtattctctatgacagtgta

SEQ ID NO: 12221 - DNA, 354 bp, Homo sapiens
ggcttgataaacaaagtgttaatttctggtcataaagagatattttagacaaattggggaggtggataattccttatttttccagagaccatgtctatgcctctcactttgcttttggccattgctgattgatctcaggattaagaaatcagatgtaagatgggctgactagattgttttctggaaaactggaaacccaaagggagggagaatgactgtacagtgatggaaggtggttggaaccaccctgtcttatagaagcagtgccctagggagaaatctgtgagctcctgctgctgaaataccggtgctgctcaatttccatgctttctgagcttagtgttttggctcttc

SEQ ID NO: 12222 - DNA, 579 bp, Homo sapiens
ggataacacagctgattatttgtaaagctgagattcttgaatacagaggtttgtggcttcaaagggctttctcccaaactctgtactgtgctgcctctgtgtacaaggttgattcttgcagaattgtttaaggaactgaaaactaaaatgtacatttgaataaggttggttaaataaggagtgtcacacacttgatgtgctgatgtgtacatccagggggtttcttcctaatagtaagggacacagcataattgaagtgcatgacgagcccccaaataagggcaagaataaactaagtaaaaattatagtacagtaattataaaaagttcaatatgtgccagtatttacaaccagtatataatgtacttaatagagctcatacagtttggagaggaaaatgtcctaaagtaaataggcaacaaaagtgagtaactgagctttaaaaagcaaatttaaatagtatgtcaagttggcaatttttcagtgagacctttcatatagtgctggtggaagtgtaagtttatggttttctataaagttgtttagcaataaataaaaactttgacgtttggtgaaat

SEQ ID NO: 12223 - DNA, 944 bp, Homo sapiens
taaaataaaataatggctaaaaatagtgacaagacttctaaacatagttacaaaaataacaaatttgcaaaatgattattttaagaaggtatgattttagttgctagctaactaatataactacatagatttataaattaatcaccaattagctatcctcatgatttaagagtgatacccacaagtagccatttgtaatactgttttttagggagtaggatagagagaatgagagtggaaggaaggcactgaagattaattgcatggaatgtacctcactttctactgttcttactcatcttcacagtaactggtagacaaaaagttaagagaaaaactgaaacagagctgcttttgcaactttgttcttgtcatatcttgccctgagattctgagggaataatttattttattttttagacagggtctcactctgtcacccaggcaggaatgtggtggcacagctcactgcagccttgacctcctgagctcaggagatcctcccacctcagcctcatgagtagctgggacgagaggcacacaccaccacacccagctaattttttaaaattattatttgtagagatggagtctcactacattgcccaggctggtcttgaactcttgggctcaagcgatcctctagctttggctttccaaagattaccagcatcatccacagcatctggcccagagggaatattttaaatgctctcctctctctggcttaccctcaagctggcttaacttcagacactgagaagtgagatcacttactaaacatgaagagagctgcattagtctctcatttgtggatacttcctgctccggcctacagttttagggttcccccaaatgaccatctcctcagagcttattctttcatttgccaaacagttgtctcatacgctatttgtgtagaatacagtgggagacaccaagtc

SEQ ID NO: 12224 - DNA, 562 bp, Homo sapiens
gagctggagccggagccaagggagtccaggctgccgggggctgcagacatggagggccagagcagcaggggcagcaggaggccagggacccgggctggcctgggttccctgcccatgccccagggtgttgcccaaactggggcaccctccaagacagagaaactgaggcgctgggcagagaggtacttgcctaaggtcacacagagctgggctttgaatctacacagccagtctcagctcccagctcttgctcctgagtggagctctgggaatgggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctc

SEQ ID NO: 12225 - DNA, 440 bp, Homo sapiens
gagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctc

SEQ ID NO: 12226 - DNA, 187 bp, Homo sapiens
  misc_feature (4)..(4): n is a, c, g, or t
  misc_feature (22)..(22): n is a, c, g, or t
  misc_feature (39)..(39): n is a, c, g, or t
  misc_feature (61)..(61): n is a, c, g, or t
acanaccaattgggcgacaaangtggccaaaattgatangaaattcgaagtagtggccatnagaagtctcagttaagtaaacaatcagcaaagccccacccaggcccccatctgggatgatgggagagctctggcagatgtcccaatcctggaggtcatccattaggaattaaattctccagcctca

SEQ ID NO: 12227 - DNA, 1755 bp, Homo sapiens
cccgctcccagtgcctcacctcctggcctaagccccgcccatgagccatccgaccctgcctccctagggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctca

SEQ ID NO: 12228 - DNA, 1505 bp, Homo sapiens
gagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatccgtagcggcaaaatgattatgagggcgtgatcatgaaaggtgataagctcttctatgcgtccgtagcggggtac

SEQ ID NO: 12229 - DNA, 802 bp, Homo sapiens
gagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcgggacctgaacttccgctattatgagcagtggggaactctagatcagcacacaac

SEQ ID NO: 12230 - DNA, 714 bp, Homo sapiens
gagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtaacgcacccctcaccccctggacagccagagaccctgctgaattcctggctccagctgtaccctggctcactgtggggcccgctgggcctctgtggctgggtccgtgacatgggtgggtggaggagcagacctgaaggtgggcgcgagggcgggggagttgtgttctgtcccccagccacgtggcctcccgctgcaggtgagttcggtgaggatgcagggtgtcatcctgctgctgttcgccaagtactaccacctgcccttcctgcgagacgtgcagaccgactgcacgcgcactggcctgggcggctactgggtgagcctgtgagcaggcccag

SEQ ID NO: 12231 - DNA, 2243 bp, Homo sapiens
gagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctca

SEQ ID NO: 12232 - DNA, 2325 bp, Homo sapiens
gagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtaacgcacccctcaccccctggacagccagagaccctgctgaattcctggctccagctgtaccctggctcactgtggggcccgctgggcctctgtggctgggtccgtgacatgggtgggtggaggagcagacctgaaggtgggcgcgagggcgggggagttgtgttctgtcccccagccacgtggcctcccgctgcagggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctca

SEQ ID NO: 12233 - DNA, 453 bp, Homo sapiens
gcatggtggtgcatgcctgtaatcccagctacttgggaggctgaggcaggagaatcgcttgaactcgggaggcagaggttgcagtgagctgagatcgtaccactgcactccagcctgagtgatacagcaagactctgtctcaaaaaaaacaaaaacaaaaaacaaactccaaagtttatcttccttggaaaatcctgaaagttttctaaaagtgaatgaatgctttatttttacgactttactttgactttagatgtgtctatacgctgcttccatgactaaaagctgtatgattgccttaattatctttgtatgctggaaaaaaatggcagaaatccattttctcttgttattctgagtgttcttttctcaaatcaaagcctgtgtggtggttttcagccacctcaatcttagtggggagattctagtggggatgttattatgttctgggac

SEQ ID NO: 12234 - DNA, 504 bp, Homo sapiens
gtgatgtgtctagtcatgtctgtcttgagatcttgcttaggtttgttgtcatttccaaatctaaagatgtgtcttttatcagttttggaaaatcagcctttatttcttctaatattattttcttccctcttccattatacacagtctggtatctttggtctgatcttttagaaatttaaatagatttattttattctggtctccatttttcttaacctcttttctcatttattttgcctctttatggctcaatctgttttaatatcatttgtgtctgacttagttcactatttctgtcttcagttttataagatatgctgttctattcattgagcttttaatttcatagattatatttttatatttttaaaagttctagttttcaaaatttgctagttcatgttttgagttatgttattgtataacattttaaatatccttacaatatatgctgtttcaggtaattttaatatctgaagcctgtgtgggaggaacaaaaaaaat

SEQ ID NO: 12235 - DNA, 378 bp, Homo sapiens
agagacaggtgtgggttcctgtttgtcctcattctctcccatttcctgtccagcttttccttctgactgctagctttgctctcctttagccacttcagtcccaccactagatgtagaggccacacccttccgtaggtttctttatcagctcccaatatggtgaaaattataattcccataataaatttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagaggc

SEQ ID NO: 12236 - DNA, 328 bp, Homo sapiens
gtatcacgatcacaactggttattattactccctataagtataataattttgctagagacccatactgtccagtgtgccctaaatcatactgctattgtactccctttgttttgaaggactttgcaactggtattgggggagatttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagaggc

SEQ ID NO: 12237 - DNA, 348 bp, Homo sapiens
actataaaatggagataatagtagctattcatagagttgtgagttaaatgagttaacctatcataagcacttagaataagtacctggcatgtgataagtgtcgtgtatatctttgttattattattgataggacagtgacgaacattcatgacacagtaatttgcaatttgatgaagcatatattggaattatagggctactaatgaagaatgaggctattgctattgacacaggtcaacaaaattccaaaaaagtagtggactggcatataataggcaaacaattgatacttatacaaataattgaattatgaatgaaagaaaaattagaaataatgaaaaagagaa

SEQ ID NO: 12238 - DNA, 451 bp, Homo sapiens
ttgagtacagagagggattttcttcaacgcatctggtagaaagctagctgtgtaaaacaaaggtagtgaattgtcccttagatatactataaatgtggttttccagggactgtatttctaggatgtgtgaaaaggttatcaatctcattttctttagtatttgaaatccttttacattcgtccctaaagcattttagtataatatgaatttgtctgttaatattgaatcaggttgatcattttgaccactgccttattattctaataatcagtgttttatggttttgtcctcaaaattagttttagacaggtgtggtggctcatgctgtaatcccaacactttgggaggctgaagtgggagggtcacttgagcccaggaggtcaaggttgtgagatcacagctcactgcacctccagcctgggcaacaagagagatgagatcctgtctcaa

SEQ ID NO: 12239 - DNA, 490 bp, Homo sapiens
attcaggattcagggtctttttttgtttgctctaataatccaacgcaccatgaatcaagcttttagtctctgctgccattgtatccttccttttcctccctctgttattgatccttgccacagccactgcaacctcattgaaagagaaactgtcactttaaagaaagaaattgaagataggctgacaccatggaaactacgtcaaacagataagaaaaatggaaggaatactgaaaatgatagatgattggagagatatggagattatattcaaggatttttattaaccactgctggatttgtctatttcagtggctctcaaacagagacaattcccctctccccgaaagggacaacttagcaatgtgtaaagacatttttggttgccacactgggaggaatgctattggtatctagtgcatagaggctgggaatgctgctaaatagcctataatgctcaggacattttcccccaacccctttaaacaaa

SEQ ID NO: 12240 - DNA, 304 bp, Homo sapiens
aataaatcagaagaatgtaggaacaaggagttaataaggatagaagtagacactaatgaattagcacattaaaaaacataaatgataaaattaaaacattatttaaaatgtaaatgtataacattacaaaatatgaaaggctataggcactaatatggagatctttaaagttataaagacatttaatgttcaagtttaggccaaataaatgtgaaaatctgagaaaaataggtgattttttaaaggaaaatacaaaccaccaaacttgaagcacagttagaaaacttgtataaatcagtaacta

SEQ ID NO: 12241 - DNA, 521 bp, Homo sapiens
ttttatgtatgtataaaatgcaatgaaattaatacaaaagtaactggagataatgataataatgtgatagtgttctgcagaattataggctaggctaaaaatctcaaaagtcaagtaagttagtatttgctaaagtcatgtagctgacaatatagtgatgaaagacatatgagaaaacattgtccacatccaaaactgaacttctgtctaactaccctagtgggcctgccctccctgcacctcttattcactatgctgactaatggcatcatccacccaggtcatccaagcctaaaccttggaggtcatcttaagcaccacctccccagacctttacaactgctgaccctcagaactagtcagtcgttaaccagcttctgacattacctaaatttctcccaaacccatcccaattttgtacccaattcttctgacttaatttaagtctatcatttttgtcagaattactagatgaattcttcagtcatatgtatagatatacacgtgctccacaggttaaa

SEQ ID NO: 12242 - DNA, 773 bp, Homo sapiens
tcttcaactaacttgcaaaattggtttttgataaagccgcttatatgcggccagaatggattataaagaccattccaagaagggtagtagcaaatcccttgtaaatagttcacaagtatattaagccatccttgttcaaattatagtgtggttttgaccagactgaaccctgattggtacaggaaacttctatgataaccatccattggtgaatgcaacaactttaaacctcaaattgggcctcagtgctattcattaatttcaatattaatttaccatggtcagatctgcacgctactcaccgcttcacttcaaaacttcccctgtgtcctttaggttccaagtcatccaacttaccaacaacttactaccagaagatgacatcaattgatattctttaaggaaataggagtctccttcaaaatccaaaattttaatactggctttgtccttctattgaccttgctcacacacctttaggcttaaaagaaaatagttggaaatgcccctcaccaataccactccccagtagattggttacttgtacctcctcaaataagctttaataggtttgtatatttcaaggaacttgtccatttcatctaagttatcaactttattagcatatatttattcacaatgttcctttattagccttttaatgtcttcagaacggaaagtgacatctcttctttcttttcttagtaagtcaggctagatgtttatcacacttactaatcatttcaaaaaaccagctattgatttcatcgcag

SEQ ID NO: 12243 - DNA, 500 bp, Homo sapiens
ggtccccaggtgaggtccccaggtgtgatccccaggtgaggtccccaggtgaggtccccaggtgtgatccccaggtgaggtgaccgtcccactttgccctagggctgctccagcttcaacgctgaaagtcccaggtcacaggaaccctcctttgcccctggcagactgaggggctatcaccctattctgggaccaacagtaaagcatcacttgggaagtggatgaagtgtgaattctgggccccaccatagacctgcttaacaggatctctggcggttagggttagggtcaggtctgctgggcagtgataatgcagctaagggcggggtcctgggtccaggtttaatctgggaagggtctgggagggactgggtttaacagaagcacccaggtgccaagcactggggcagagctggaatcccgtcagacggtgggcagacctgcagccgaccaccactctctgccgaggggaggggtcctgacagtgccgtgtccaccag

SEQ ID NO: 12244 - DNA, 489 bp, Homo sapiens
gaatgcaaatgagggtgctatgccttttcctcaactacacaaagcaaatgggtaggtctagtgaaggcagagaggccagctcccttccaggaaaggctttgttctcactacctatgaaggcagcagtgttgacagtgaaagaaaccgtttctcagctctgtttgcccgctgtaggcacaacgatctatgacagagaggctgggaagcatcctttatgtctctagattctctgtgtccctcctacactagataaccatctccaaaaaccatataaccatttcctgtttgttggtctccctgggaggtttttctgccttccacctgcttgagagggcctcttcaatctgatgcagtggtgactggctgagattctcccaagtccacatgctttctaatctcctaccctatcatctgcatgtactcacatcacctctgccatctctctggtgtggttctcagaggcatgaggcagcccagtcaaagccagtc

SEQ ID NO: 12245 - DNA, 499 bp, Homo sapiens
agccttcgggctaggttgagtgagggctcttgggttagttcctgttaggccccggcgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatatgtgatgctgatccttcagccttagccaactatgttgtagcactggtcaagaaggacaaacctgagaaagaattaaaagccttttgtgctgatcaacttgatgtctttttacaaaaagaaacttcaggttttgtggacaaactatttgaaagtctctatactaagaactaccttccacttttggaaccagtaaagcctgagccaaaaccactagtccaagaaaaagaagaaattaaagaagag

SEQ ID NO: 12246 - DNA, 592 bp, Homo sapiens
agccttcgggctaggttgagtgagggctcttgggttagttcctgttaggccccggcgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatatgtgatgctgatccttcagccttagccaactatgttgtagcactggtcaagaaggacaaacctgagaaagaattaaaagccttttgtgctgatcaacttgatgtctttttacaaaaagaaacttcaggttttgtggacaaactatttgaaagtctctatactaagaactaccttccacttttggaaccagtaaagcctgagccaaaaccactagtccaagaaaaagaagaaattaaagaagaggtatttcaggagccagcagaggaagaacgagatggcagaaaaaagaaatatcctagtccccagaagactcgttcagaatctagtgaacgaagg

SEQ ID NO: 12247 - DNA, 438 bp, Homo sapiens
cgagactctgtctccacacagaggaacacttggcatcagggagtctgttgtctgacccgcaactaggcagcctcatacattattttcactaagagaccagtggggctggaaagggacttgtgaggtgctaagtagccagtgagagcttctgggtcctgtcgcagttttgccctttcttccctcaaaaaaaggtctctccacttctctgtgggaaaggcttgggcaagttctctggtttccaatgaggccagagaacctgtgctgatccctaacatcttcacccatcgggggcaaaataagtaaaataaaagtaatgtagcaaatgtttttataaaagtgttaatttaaattaacggactattacctattcttagagctttctcttttgtttttggcattaaaatatcctttctattataaaatgataagttggtgatt

SEQ ID NO: 12248 - DNA, 729 bp, Homo sapiens
gtagagctgatggaggagtaagggacagagaacttaagctttgggctttcttctaccagaaatgccactgcaggcaagtcacttaaccactcaaagatttagtttcttccactacaaaacaggaataacattgcctttgccaactacaaaagctcaaataagaagcatttggggcaaagactgttttgtacaatagaaatgtaagagaacttatctttaatatttaattgcactccattaggtctcttcatgtccccatggcgtggtccccaagtgacttaagatacatttggatgccatctgctcaacaagaagactgactgacaaatttcaagcacacagacagcaacatcaggggacctctctctctcccaaccctggtggcttttgattttacagaaagcaaaagcatctgataaacaaagccctgaggtagtcctgattcctcaattacccctaagtagcaacagatgctgcacagagggacttgcttcagtgaccaatgctctcagtaattagacaatggagggagaaagtaattaggtaaaccacaaagaagtagaaataaactgtatgggatatgttggtcatggatgaaagacaaattaaaaaaaagtataaaggaaacatctaggaaaaaataactaataaataatttgcttaatccatgttgaataatcaatttaagcctgtgaagttaaacctgattaaagatatcccttaattaaa

SEQ ID NO: 12249 - DNA, 458 bp, Homo sapiens
gcctactactactaaattaaaaaacggtcgacaacaaaacatacttagcatattaaagtttatgacagtcctatagtaaagcaataaataaaaactagttagctttgtttaattcagcattgcctcacttagagtatagatatcctatggaacacagtttggtaaatgctgatttagactgttacaaaattggcccctttgctgtttcatccataatttcatctataaagaaaagcttcctttcttaaaaatactttatatatggccagacgcaatagcttacacctgtaatcccagcactttgggaggccgaggcaggcggatcacaaggtcaggaaatcaaaaccatcctggccaacatggtgaaaccctgtctctactaaaatgcaaaaattatctgggcatggtgttacgtgcctgtaatcccagctacttgggaagctgaggcaggagaatcg

SEQ ID NO: 12250 - DNA, 815 bp, Homo sapiens
aaataaaaataaaaaaaaaaaaaaaaaaaaaaaaaaaaaaaaaaaaaaaaaaaaaaaaaaaaaaaaaaaaaaaagaaatctgaaacacttctgatcccaagcatttcagaaaacggatgttcatttgtgtgtgtgtgtgtgtgtaagcaggtgttgctagaaattcacttatatacaagaaaactttttgtgtacatatttgcatatatatgtacaaatgggtagaaacgatacatgattaatcttaatcgggaaggaaaagagatttagggaaggaagcagtaagtgagaacttttattctatttactcctgcacgtttaaatattgtttacagtgagtatatcaacatgtaagtgttaaaagacaataagctactagtgatttttaatataaaattaactataaaatattttaaatattagcaaataatatagcacactcatgaacctaattcccacatttgatagttgttacattttgccatgtttgtttaaaggtctaagtcataaaatcttataaagctaaaccccacccttctctttctcctctctctccaggataattactgttttatagtttgtggatatcattcccttacttgtgtttatacttttaccaagtgtgtatgtattcaaaaaacagttgttttgtgattttaaaatgtaaatgaatggcgttatgctccatgtattctgcaacttttcatcatacattaggttttggcgatttagccataatttggcatgaattcaggtcttttaagttttattccattgtaagaataaacaagtttgttcattcatgtctccattga

SEQ ID NO: 12251 - DNA, 615 bp, Homo sapiens
  misc_feature (512)..(512): n is a, c, g, or t
  misc_feature (544)..(544): n is a, c, g, or t
  misc_feature (585)..(585): n is a, c, g, or t
  misc_feature (593)..(593): n is a, c, g, or t
caccatgttgcccaggctggagtgcagtagctattcataggcacagtcatagcacactgcagcctagaatttctgacctcaagcaatcatcctgcctcagcctcctgagtagctaggactacaggtgcataccaccataaccagctttaattaaatgttttttatttggttattttttttaagttttctgtattcacacaaggggttgcccaaatataattttgctttgactattgagatctagtgaaagtggggtatatgaattctaattgcaaatatccaggctcagaggcccagcaggactttctaacacaatcttttagcggaagttagaaatggtatatagcaggagagtcagatttgagaagcatatgtagattcgaagctgggattacaggtgtaagccactgcaccctgcctattcttataatcatatatttatatttcaaatgggattttaactgggttatttaatagtttaattaggataaagtaattcagggcggggtgtnggtggctcacgcctgtaaatcccagcactttnggcagggctgagggcagggtgggttaccccgagggtccggnagtttcgnggacccagccccaacccaacgt

SEQ ID NO: 12252 - DNA, 2902 bp, Homo sapiens
caccatgttgcccaggctggagtgcagtagctattcataggcacagtcatagcacactgcagcctagaatttctgacctcaagcaatcatcctgcctcagcctcctgagtagctaggactacaggtgcataccaccataaccagctttaattaaatgttttttatttggttattttttttaagttttctgtattcacacaaggggttgcccaaatataattttgctttgactattgagatctagtgaaagtggggtatatgaattctaattgcaaatatccaggctcagaggcccagcaggactttctaacacaatcttttagcggaagttagaaatggtatatagcaggagagtcagatttgagaagcatatgtagattcgaagctgggggaatatggcaggtagtttgtacaacatctaattcagaacattaaaattaagattttagtcaaactgtgtttaagttagttcttattttcctgtagatgcatctcacagcatcagtacaataccaaaaaagcacacaagaataagaatatgtggaatttctatacctattgacaaagcacataatttaaccataaacacaaagccataggtcaacaaagaaatgaagattccagttctgaaggtgagttttctgaagccaaagtggatacatgcaaaattaatatagttttactgtatatcagttgtcaccaatcagaaatggaaaacagatcctatttataattgcaaacaaaactgtaaaatagactttttaaagtctgggaatagacttctaaaataagctataacacttaaaaaggagagatatactatgttcctagataggacaattgaaaattctggagatgacagtttttcaaaaatctattgaggccaggtgcagtggcccatgcctgtagttccagtactttgggaggcctaggtgggtggatcacctgaggttgggagtttgagaccagcctgaccaacatggagaaaccccgtctctactaaaaatacaaaattagccaggcgtggtggtgcatgcctgtaatcccagctactcgggaggctgaggcgtgagaatcgcttgaacccggtaggcagatgttgcagtgagccgagatcgcaccattgcactccagcctaggcaacaagagcgaaactccatctcaaaaatagaaaaaacatttatcgaaatcccaacaagttgacaaatatatccacataaaaatataaaacttctgtattctgtgaaagctactataaataaagtttagagaaagttatttgccacctatgtcatgattgaaatagttaattgatcctgtgaatcagttagcaaaacataactcaatggaaagataggcaaatgatacaaataagaaattcacaaaagaagaaatactaagtctctagtgatgagagaaatgtaaattaaaatgaaacatgtttgttcatcaagttgtcacaagttagacaatcatatccaatatttttaaaggttgtaagactataaggaaatagccactgtcatatcatttttaaaggaatataaattatagggccttttgtttctttgggttttttttttttagagacaagatctctccgtgttgtctaggctggactcaaacttctggactcaagcaatcctcgcaacatcattaatagctgagagtagagacttgagccaccacacctgactatagggcctttttgaaaggaaaattgacatcatcaaaattttaaatatattcagtctatttctcaaaaactcaaagaatactaataaatgtgtactcaggtatatgtacagaaattgctgtaacattataattttaaacaatttaaaacagactgagtttccaaagttagggtacaatgaaagaaaaggtggcttatttatactctggaatattttccaagagttgaaaaggatgaggatacacacacacacacacacacacacacacacacacacacacacacacagtttgggtatccctaatccagaaattcaaatgctccaaagtccaaaactttctgacccaccaacatgactgatgctcaaaggaaatggccactggaagatttcagattttcagatttggagtgctcaaccagtaagtatataatgcaaataatccaaaatacaaaaaaaaaaaaaaagaaatctgaaacacttctgatcccaagcatttcagaaaacggatgttcatttgtgtgtgtgtgtgtgtgtaagcaggtgttgctagaaattcacttatatacaagaaaactttttgtgtacatatttgcatatatatgtacaaatgggtagaaacgatacatgattaatcttaatcgggaaggaaaagagatttagggaaggaagcagtaagtgagaacttttattctatttactcctgcacgtttaaatattgtttacagtgagtatatcaacatgtaagtgttaaaagacaataagctactagtgatttttaatataaaattaactataaaatattttaaatattagcaaataatatagcacactcatgaacctaattcccacatttgatagttgttacattttgccatgtttgtttaaaggtctaagtcataaaatcttataaagctaaaccccacccttctctttctcctctctctccaggataattactgttttatagtttgtggatatcattcccttacttgtgtttatacttttaccaagtgtgtatgtattcaaaaaacagttgttttgtgattttaaaatgtaaatgaatggcgttatgctccatgtattctgcaacttttcatcatacattaggttttggcgatttagccataatttggcatgaattcaggtcttttaagttttattccattgtaagaataaacaagtttgttcattcatgtctccattga

SEQ ID NO: 12253 - DNA, 2027 bp, Homo sapiens
gtttttaaactctacgtcaagtagtctccccaatggtattctgcaatctctgaccattgtaacctcacaaatattctcaaaacctggccctgaattttcaagaacatctctcatacccttattaggattgaatctaaaaaggtcgggcacagtgactcatgcctgtaatcccagctactcgggaggctgaggcgtgagaatcgcttgaacccggtaggcagatgttgcagtgagccgagatcgcaccattgcactccagcctaggcaacaagagcgaaactccatctcaaaaatagaaaaaacatttatcgaaatcccaacaagttgacaaatatatccacataaaaatataaaacttctgtattctgtgaaagctactataaataaagtttagagaaagttatttgccacctatgtcatgattgaaatagttaattgatcctgtgaatcagttagcaaaacataactcaatggaaagataggcaaatgatacaaataagaaattcacaaaagaagaaatactaagtctctagtgatgagagaaatgtaaattaaaatgaaacatgtttgttcatcaagttgtcacaagttagacaatcatatccaatatttttaaaggttgtaagactataaggaaatagccactgtcatatcatttttaaaggaatataaattatagggccttttgtttctttgggttttttttttttagagacaagatctctccgtgttgtctaggctggactcaaacttctggactcaagcaatcctcgcaacatcattaatagctgagagtagagacttgagccaccacacctgactatagggcctttttgaaaggaaaattgacatcatcaaaattttaaatatattcagtctatttctcaaaaactcaaagaatactaataaatgtgtactcaggtatatgtacagaaattgctgtaacattataattttaaacaatttaaaacagactgagtttccaaagttagggtacaatgaaagaaaaggtggcttatttatactctggaatattttccaagagttgaaaaggatgaggatacacacacacacacacacacacacacacacacacacacacacacacagtttgggtatccctaatccagaaattcaaatgctccaaagtccaaaactttctgacccaccaacatgactgatgctcaaaggaaatggccactggaagatttcagattttcagatttggagtgctcaaccagtaagtatataatgcaaataatccaaaatacaaaaaaaaaaaaaaagaaatctgaaacacttctgatcccaagcatttcagaaaacggatgttcatttgtgtgtgtgtgtgtgtgtaagcaggtgttgctagaaattcacttatatacaagaaaactttttgtgtacatatttgcatatatatgtacaaatgggtagaaacgatacatgattaatcttaatcgggaaggaaaagagatttagggaaggaagcagtaagtgagaacttttattctatttactcctgcacgtttaaatattgtttacagtgagtatatcaacatgtaagtgttaaaagacaataagctactagtgatttttaatataaaattaactataaaatattttaaatattagcaaataatatagcacactcatgaacctaattcccacatttgatagttgttacattttgccatgtttgtttaaaggtctaagtcataaaatcttataaagctaaaccccacccttctctttctcctctctctccaggataattactgttttatagtttgtggatatcattcccttacttgtgtttatacttttaccaagtgtgtatgtattcaaaaaacagttgttttgtgattttaaaatgtaaatgaatggcgttatgctccatgtattctgcaacttttcatcatacattaggttttggcgatttagccataatttggcatgaattcaggtcttttaagttttattccattgtaagaataaacaagtttgttcattcatgtctccattga

SEQ ID NO: 12254 - DNA, 2125 bp, Homo sapiens
caccatgttgcccaggctggagtgcagtagctattcataggcacagtcatagcacactgcagcctagaatttctgacctcaagcaatcatcctgcctcagcctcctgagtagctaggactacaggtgcataccaccataaccagctttaattaaatgttttttatttggttattttttttaagttttctgtattcacacaaggggttgcccaaatataattttgctttgactattgagatctagtgaaagtggggtatatgaattctaattgcaaatatccaggctgaggcgtgagaatcgcttgaacccggtaggcagatgttgcagtgagccgagatcgcaccattgcactccagcctaggcaacaagagcgaaactccatctcaaaaatagaaaaaacatttatcgaaatcccaacaagttgacaaatatatccacataaaaatataaaacttctgtattctgtgaaagctactataaataaagtttagagaaagttatttgccacctatgtcatgattgaaatagttaattgatcctgtgaatcagttagcaaaacataactcaatggaaagataggcaaatgatacaaataagaaattcacaaaagaagaaatactaagtctctagtgatgagagaaatgtaaattaaaatgaaacatgtttgttcatcaagttgtcacaagttagacaatcatatccaatatttttaaaggttgtaagactataaggaaatagccactgtcatatcatttttaaaggaatataaattatagggccttttgtttctttgggttttttttttttagagacaagatctctccgtgttgtctaggctggactcaaacttctggactcaagcaatcctcgcaacatcattaatagctgagagtagagacttgagccaccacacctgactatagggcctttttgaaaggaaaattgacatcatcaaaattttaaatatattcagtctatttctcaaaaactcaaagaatactaataaatgtgtactcaggtatatgtacagaaattgctgtaacattataattttaaacaatttaaaacagactgagtttccaaagttagggtacaatgaaagaaaaggtggcttatttatactctggaatattttccaagagttgaaaaggatgaggatacacacacacacacacacacacacacacacacacacacacacacacagtttgggtatccctaatccagaaattcaaatgctccaaagtccaaaactttctgacccaccaacatgactgatgctcaaaggaaatggccactggaagatttcagattttcagatttggagtgctcaaccagtaagtatataatgcaaataatccaaaatacaaaaaaaaaaaaaaagaaatctgaaacacttctgatcccaagcatttcagaaaacggatgttcatttgtgtgtgtgtgtgtgtgtaagcaggtgttgctagaaattcacttatatacaagaaaactttttgtgtacatatttgcatatatatgtacaaatgggtagaaacgatacatgattaatcttaatcgggaaggaaaagagatttagggaaggaagcagtaagtgagaacttttattctatttactcctgcacgtttaaatattgtttacagtgagtatatcaacatgtaagtgttaaaagacaataagctactagtgatttttaatataaaattaactataaaatattttaaatattagcaaataatatagcacactcatgaacctaattcccacatttgatagttgttacattttgccatgtttgtttaaaggtctaagtcataaaatcttataaagctaaaccccacccttctctttctcctctctctccaggataattactgttttatagtttgtggatatcattcccttacttgtgtttatacttttaccaagtgtgtatgtattcaaaaaacagttgttttgtgattttaaaatgtaaatgaatggcgttatgctccatgtattctgcaacttttcatcatacattaggttttggcgatttagccataatttggcatgaattcaggtcttttaagttttattccattgtaagaataaacaagtttgttcattcatgtctccattga

SEQ ID NO: 12255 - DNA, 2882 bp, Homo sapiens
caccatgttgcccaggctggagtgcagtagctattcataggcacagtcatagcacactgcagcctagaatttctgacctcaagcaatcatcctgcctcagcctcctgagtagctaggactacaggtgcataccaccataaccagctttaattaaatgttttttatttggttattttttttaagttttctgtattcacacaaggggttgcccaaatataattttgctttgactattgagatctagtgaaagtggggtatatgaattctaattgcaaatatccaggctcagaggcccagcaggactttctaacacaatcttttagcggaagttagaaatggtatatagcaggagagtcagatttgagaagcatatgtagattcgaagctgggggaatatggcaggtagtttgtacaacatctaattcagaacattaaaattaagattttagtcaaactgtgtttaagttagttcttattttcctgtagatgcatctcacagcatcagtacaataccaaaaaagcacacaagaataagaatatgtggaatttctatacctattgacaaagcacataatttaaccataaacacaaagccataggtcaacaaagaaatgaagattccagttctgaaggtgagttttctgaagccaaagtggatacatgcaaaattaatatagttttactgtatatcagttgtcaccaatcagaaatggaaaacagatcctatttataattgcaaacaaaactgtaaaatagactttttaaagtctgggaatagacttctaaaataagctataacacttaaaaaggagagatatactatgttcctagataggacaattgaaaattctggagatgacagtttttcaaaaatctattgaggccaggtgcagtggcccatgcctgtagttccagtactttgggaggcctaggtgggtggatcacctgaggttgggagtttgagaccagcctgaccaacatggagaaaccccgtctctactaaaaatacaaaattagccaggcgtggtggtgcatgcctgtaatcccagctactcgggaggctgaggcgtgagaatcgcttgaacccggtaggcagatgttgcagtgagccgagatcgcaccattgcactccagcctaggcaacaagagcgaaactccatctcaaaaatagaaaaaacatttatcgaaatcccaacaagttgacaaatatatccacataaaaatataaaacttctgtattctgtgaaagctactataaataaagtttagagaaagttatttgccacctatgtcatgattgaaatagttaattgatcctgtgaatcagttagcaaaacataactcaatggaaagataggcaaatgatacaaataagaaattcacaaaagaagaaatactaagtctctagtgatgagagaaatgtaaattaaaatgaaacatgtttgttcatcaagttgtcacaagttagacaatcatatccaatatttttaaaggttgtaagactataaggaaatagccactgtcatatcatttttaaaggaatataaattatagggccttttgtttctttgggttttttttttttagagacaagatctctccgtgttgtctaggctggactcaaacttctggactcaagcaatcctcgcaacatcattaatagctgagagtagagacttgagccaccacacctgactatagggcctttttgaaaggaaaattgacatcatcaaaattttaaatatattcagtctatttctcaaaaactcaaagaatactaataaatgtgtactcaggtatatgtacagaaattgctgtaacattataattttaaacaatttaaaacagactgagtttccaaagttagggtacaatgaaagaaaaggtggcttatttatactctggaatattttccaagagttgaaaaggatgaggatacacacacacacacacacacacacacagtttgggtatccctaatccagaaattcaaatgctccaaagtccaaaactttctgacccaccaacatgactgatgctcaaaggaaatggccactggaagatttcagattttcagatttggagtgctcaaccagtaagtatataatgcaaataatccaaaatacaaaaaaaaaaaaaaagaaatctgaaacacttctgatcccaagcatttcagaaaacggatgttcatttgtgtgtgtgtgtgtgtgtaagcaggtgttgctagaaattcacttatatacaagaaaactttttgtgtacatatttgcatatatatgtacaaatgggtagaaacgatacatgattaatcttaatcgggaaggaaaagagatttagggaaggaagcagtaagtgagaacttttattctatttactcctgcacgtttaaatattgtttacagtgagtatatcaacatgtaagtgttaaaagacaataagctactagtgatttttaatataaaattaactataaaatattttaaatattagcaaataatatagcacactcatgaacctaattcccacatttgatagttgttacattttgccatgtttgtttaaaggtctaagtcataaaatcttataaagctaaaccccacccttctctttctcctctctctccaggataattactgttttatagtttgtggatatcattcccttacttgtgtttatacttttaccaagtgtgtatgtattcaaaaaacagttgttttgtgattttaaaatgtaaatgaatggcgttatgctccatgtattctgcaacttttcatcatacattaggttttggcgatttagccataatttggcatgaattcaggtcttttaagttttattccattgtaagaataaacaagtttgttcattcatgtctccattga

SEQ ID NO: 12256 - DNA, 897 bp, Homo sapiens
  misc_feature (875)..(875): n is a, c, g, or t
caccatgttgcccaggctggagtgcagtagctattcataggcacagtcatagcacactgcagcctagaatttctgacctcaagcaatcatcctgcctcagcctcctgagtagctaggactacaggtgcataccaccataaccagctttaattaaatgttttttatttggttattttttttaagttttctgtattcacacaaggggttgcccaaatataattttgctttgactattgagatctagtgaaagtggggtatatgaattctaattgcaaatatccaggctcagaggcccagcaggactttctaacacaatcttttagcggaagttagaaatggtatatagcaggagagtcagatttgagaagcatatgtagattcgaagctgggggaatatggcaggtagtttgtacaacatctaattcagaacattaaaattaagattttagtcaaactgtgtttaagttagttcttattttcctgtagatgcatctcacagcatcagtacaataccaaaaaagcacacaagaataagaatatgtggaatttctatacctattgacaaagcacataatttaaccataaacacaaagccataggtcaacaaagaaatgaagattccagttctgaaggtgagttttctgaagccaaagtggatacatgcaaaattaatatagttttactgtatatcagttgtcaccaatcagaaatggaaaacagatcctatttataattgcaaacaaaactgtaaaatagactttttaaagtctgggaatagacttctaaaataagctataacacttaaaaaggagaattacttgagccagggaagcagaggttgtggtgagctaagattgtgccactgcactccagcntgagagaacaagactccgtctc

SEQ ID NO: 12257 - DNA, 970 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggtaagaaagattctgtaagacaatgaactttaatgataatcgtatatttggtttttgccttatctactaaccaataataccaaacacagcctactgtttgtcctcacagagactaagtatattactctaatcactgatcatttaggctcggagactttatttcatatctgtttgaacacattgatccaaaatagcattttccaaagcaattttattgaatatttgctctgcatt

SEQ ID NO: 12258 - DNA, 2202 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatgg

SEQ ID NO: 12259 - DNA, 2231 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttaaaaaaa

SEQ ID NO: 12260 - DNA, 2583 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacatttgtctgccatgtctctacagaatcagtgaatctcagtgttttcacctgagaagcttcatgagggcggagaatatactccctgatccctgggccacagtaagcactctaggaatatacacagatgaggacattagagagtgaatagcgagaagaaaacctcactctcagcctctggttcttagcatagggcctttttttccatgctaaaacaacctgtggcctttaaattatcagcaacttgaaatgctggaaaattggggttttgccatatcactctgacagttgatgaggaaaggcgatttttcaacattgagacaagagacttcatttttttctttttatttcttccaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttaaaaaaa

SEQ ID NO: 12261 - DNA, 2421 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacatttgtctgccatgtctctacagaatcagtgaatctcagtgttttcacctgagaagcttcatgagggcggagaatatactccctgatccctgggccacagtaagcactctaggaatatacacagatgaggacattagagagtgaatagcgagaagaaaacctcactctcagcctctggttcttagcatagggcctttttttccatgctaaaacaacctgtggcctttaaattatcagcaacttgaaatgctggaaaattggggttttgccatatcactctgacagttgatgaggaaaggcgatttttcaacattgagacaagagacttcatttttttctttttatttcttccaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttaaaaaaa

SEQ ID NO: 12262 - DNA, 2329 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacatttgtctgccatgtctctacagaatcagtgaatctcagtgttttcacctgagaagcttcatgagggcggagaatatactccctgatccctgggccacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttaaaaaaa

SEQ ID NO: 12263 - DNA, 2349 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggtgggagtcaaggcagggaatataagcacgattttggtggtctttgtcccaccagagtgggagcaggctctcctgaatgttgagaccaacctggcttaccaggatatttcttccttgggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttaaaaaaa

SEQ ID NO: 12264 - DNA, 1746 bp, Homo sapiens
gaatctaataattctaaagcactccttgtatcatgtatctccctttatttcaatatctccttaattctctatacctgtgagataaagtcctgatcccttaacatagttttatgaaatctggccaaaaattaccttccaacttacagtagcatatgaattccttatacattcctgtcacccaactttgcccacaattttttccatcttatatgacctccactctatctaaaattattaagactcgttccagtcttacctcttccataaagtctaacctacccccatagactcatctgaatgtgacatttaatcacatactactctatggtagctcatgaagtctcatatttttatttaattctgctatcttatatctgtaacttcataagattctaggacagagatcatgagttatctttatttctcctattatatctaatatagtgctatttaatagtagctatgtcaaattaagttatgatgacttttattcattcaacttcattattaaatgttcttcattattcatttgtagtttgtctgccatgtctctacagaatcagtgaatctcagtgttttcacctgagaagcttcatgagggcggagaatatactccctgatccctgggccacagtaagcactctaggaatatacacagatgaggacattagagagtgaatagcgagaagaaaacctcactctcagcctctggttcttagcatagggcctttttttccatgctaaaacaacctgtggcctttaaattatcagcaacttgaaatgctggaaaattggggttttgccatatcactctgacagttgatgaggaaaggcgatttttcaacattgagacaagagacttcatttttttctttttatttcttccaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttaaaaaaa

SEQ ID NO: 12265 - DNA, 2239 bp, Homo sapiens
  misc_feature (2239)..(2239): n is a, c, g, or t
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggcctcgtcggcctcagcggtggagctctgccggcggan

SEQ ID NO: 12266 - DNA, 1778 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacatttgtctgccatgtctctacagaatcagtgaatctcagtgttttcacctgagaagcttcatgagggcggagaatatactccctgatccctgggccacagtaagcactctaggaatatacacagatgaggacattagagagtgaatagcgagaagaaaacctcactctcagcctctggttcttagcatagggcctttttttccatgctaaaacaacctgtggcctttaaattatcagcaacttgaaatgctggaaaattggggttttgccatatcactctgacagttgatgaggaaaggcgatttttcaacattgagacaagagacttcatttttttctttttatttcttccatttaagtatctgtctttgatcccggcctcacctgtatctcttcggggatcctct

SEQ ID NO: 12267 - DNA, 1002 bp, Homo sapiens
  misc_feature (846)..(846): n is a, c, g, or t
  misc_feature (851)..(851): n is a, c, g, or t
  misc_feature (913)..(913): n is a, c, g, or t
  misc_feature (981)..(981): n is a, c, g, or t
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggnccatnactgtccttggttcaagccactgcactccagcctgggtgacaagaggaagaccttgtccccncaaaaagaaaaacattagtttcagtcaaacccacgttcgttccctaccatgtgtagctgtggggcccntacacaaagtgaaattgcctc

SEQ ID NO: 12268 - DNA, 780 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggtaagaaagattctgtaagacaatgaactttaatgataatcgta

SEQ ID NO: 12269 - DNA, 253 bp, Homo sapiens
cctcatgttttatgtaaatttttcttgttagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcgggtaagtgaaaatgaaaatgttttgttataaaatcatccatgcaagattaaatggtagttatc

SEQ ID NO: 12270 - DNA, 1790 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatg

SEQ ID NO: 12271 - DNA, 2299 bp, Homo sapiens
ggaaatctataattctttttctgtgcacacatggacttgtggcacatggaaatgtgcgcacagaaaaaggaaatctataattcttttaaagtaggaaggcattcttccttgccagaatgtacccattttcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttaaaaaaa

SEQ ID NO: 12272 - DNA, 2203 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttaaaaaaa

SEQ ID NO: 12273 - DNA, 2142 bp, Homo sapiens
tccggaagtgacagtaacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacatttgtctgccatgtctctacagaatcagtgaatctcagtgttttcacctgagaagcttcatgagggcggagaatatactccctgatccctgggccacagtaagcactctaggaatatacacagatgaggacattagagagtgaatagcgagaagaaaacctcactctcagcctctggttcttagcatagggcctttttttccatgctaaaacaacctgtggcctttaaattatcagcaacttgaaatgctggaaaattggggttttgccatatcactctgacagttgatgaggaaaggcgatttttcaacattgagacaagagacttcatttttttctttttatttcttccaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatg

SEQ ID NO: 12274 - DNA, 272 bp, Homo sapiens
gtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacttcttgcatgaaaatagtacgttgcgggaagaaattgccatgctaagactggagctagacacaatgaaacatcagagccagctaagaaaaaagaaatatttggaggatattgaaagtgtg

SEQ ID NO: 12275 - DNA, 420 bp, Homo sapiens
ttcagagcaggaaattgagaaactatatcacagatctgatgtccagggccagagaattaacatgttcatctccaagcctggtaccaagtcccttcacaaaaatacagatgccaccttcaggaagcctccacgagaaagtggaggcagccagggaagccttggcaagggaaaccacacagcggcgccgtccccagcgcaagtttgccttggttcaggagctcagtgggcaagccctgggggctggctgggaaaggaagttgatgagcagctacggaggggcgtccagtctgcatgaggactcagagcttctcaggcagagagccatctgagccatcatgtgggccataacgtgactcactctgggtccattgagagcatcatccgcgtgggcctacctcaaacctctttcaccagcactcc

SEQ ID NO: 12276 - DNA, 620 bp, Homo sapiens
aactctggagagactgaaactgcctttggcctctacttggtcttgagatatggtctacaacatttccctttacgtgaatgacagacagccctaaaatctgtcgacaatttgaccccatgcttgggtgcactgtgagcctagtgaattatagcaaggaaaggggatgattatcttaaatcatggacaaaatcctatttgggccagtacactttgcttatgagtagctctacattaaaatttaaatattaggttggcagctattttctttcagcatttagaaatatcaacctgggttgatgcagtggctcatgcctgtaatcccagcaatttgggaggccaacgtgggtggactgcttgagcccaggagtttgagaccagcctgggcaacatagcgagaccatgtctctacaaaaaagtgaaaaaattagccagtcatggtgtcccacacctgtagtcccagctactcgagaggctgaggtgggaggatcgctggagcctggaagattgaggctacagtgagctgtgattgtgccactgcattccagtctgggtaacagagcaagactctgtctcaaaaaacaaaacaaaacaaacaaacaaaaaaaaacaaagaaagaaag

SEQ ID NO: 12277 - DNA, 169 bp, Homo sapiens
gtttcactgctcctgatgtttaacgttatgcaaagacgtgtttctgccaatgaatatcgccttacggttatgcttctgcaaatagcctgctgtgagctgataaagggattaatgcagccaaaattcttaatctgtaaaattacaaattaaattctcatattaaaaatac

SEQ ID NO: 12278 - DNA, 267 bp, Homo sapiens
aatagtggtcaaagcaaggtagtttagaaacatgaaagcaatatgtagagattgaaagtaggtgccctaaacagcagaaatctgggatgttgaagtaaaaacaactgctattcttttattataaaccttttactataaactacttgactttttaaaactttaaatcccatatgcatcacttattttaaaataaaaattgactgggcacggtttctcacatctgcaatcccagtgctttgggaggctgagtcgggaaaatcacttgag

SEQ ID NO: 12279 - DNA, 733 bp, Homo sapiens
ggatgacctaatttagaaactataggagaattaggggaagctctttggaggaagtggtgcctaatgttgacataaaagaaataatgaagcaaggagagggagaccagaattacgggcagaaggaatagcatttgtaaaagtaggttccgggaggtaagaagggcaacttttacatgcctgttataggagctagcataaagtagagttctatggtgagaagagattatttagtgctgccattccagcaataactgagaggtagattttaaaatggcacaaataatacacatttgtttggtgatggggaaataagttcatggaaggctatgagttgtttatgaatagactaggttcatgatattggacttcttaccagtttggccctagttttgttgcagaacagattataactgggatcagagtatttagcaaaggatctatcccaaggctaaagattaacctaagaagaaaagcacgaacatgttaccacaaattctctctgtagtctgaagatacctaataataccaaagaaaggcaggcaaaaatgactgactttcttgctgcaattaagaaattctgctttctgtgaatgaatgcgtggtaaaaaaaaaaaaaatactcatatgttctgaaccgttcctctccctattcagacatgggagcttacagcgtattaagcaagtactttattcattattctgttaaaggcattcccatggacaacacacgggg

SEQ ID NO: 12280 - DNA, 383 bp, Homo sapiens
gttcatttgtataccagtgcacagtaatgctattacatttatgaggttgtgtttactttttaatttggaaggctctgtttctcagaattggttgcaacccgccaggtgtggtggcttacgcctgtaatctcagcactttgggaggctgaggcaggcagatcacttgaggtcaagagtttgagaccaacttggccaacatggtgaaaccccatgtcactactaaaaatgctaacattagctgggcatggtggcgcatgcctcttatcccagctactcgtgaggctgaggcaggagaatcgcttcaacctgggaggcagaggttgcagtgagctgagatcatgcctctaaactccagcctgggcattagagggagactctgtctc

SEQ ID NO: 12281 - DNA, 1815 bp, Homo sapiens
aactcacgcgctggcgggaccctcagggctttaccagcaactaccccagtgccggggagggttctgctgcttcgaaagctgctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaataggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcaaagaatttttgtagaaatgtagtcctgtgattgtcattttttcccctaatttctctaattgttacattcttagtattttaatccatattaaatttatatggctataaatttc

SEQ ID NO: 12282 - DNA, 2447 bp, Homo sapiens
aactcacgcgctggcgggaccctcagggctttaccagcaactaccccagtgccggggagggttctgctgcttcgaaagctgtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaataggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcaaagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattcttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattttatacccagtaaaaaagaaaagagaacataagcaaaatattggtgcactaatgagga

SEQ ID NO: 12283 - DNA, 2680 bp, Homo sapiens
ctcggctttgtgcggcggtggagctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaataggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcaaagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattcttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattttatacccagtaaaaaagaaaagagaacataagcaaaatattggtgcactaatgagga

SEQ ID NO: 12284 - DNA, 2515 bp, Homo sapiens
aactcacgcgctggcgggaccctcagggctttaccagcaactaccccagtgccggggagggttctgctgcttcgaaagctgctctacccttctccaaaagaagagccaagagaaggtccttttctacaaatatcagagccatggctcagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaataggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcaaagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattcttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattttatacccagtaaaaaagaaaagagaacataagcaaaatattggtgcactaatgagga

SEQ ID NO: 12285 - DNA, 1241 bp, Homo sapiens
aactcacgcgctggcgggaccctcagggctttaccagcaactaccccagtgccggggagggttctgctgcttcgaaagctgctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaataggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacagaaaaatggataactatacatttccctgaaatttgcttttttacattcaactgtacattttggattttccttcaatagatgatgatctaacagtctttctgatggttacagtatgttccacagtgttatttaccaatgccttttcaaccactttcccaattgtgatattatggattgtttgcgcttttttgccatctaaaagtaatgctgcaacaaacactttgtattcttgtctgttttatttctataaaataagcttcccaagtc

SEQ ID NO: 12286 - DNA, 458 bp, Homo sapiens
gaaatactgtgaagaaccagcatcttctagtctacctggatatagtcatggttgttatagaaacagtatggggccgaactgtctgccccatacacaagcagccaagcaattctttaattataaaactaaaagccagattctttgttatattttagtatgctatttgcatctatattccatgtatcccttagcaatgttgtattattgacctaaaaaagagtgtcttcttcacaacatggatggtactggacacctttacaatatcacatccctgcctaactggtcagtcccctagacaccatgcaagctattactactaataataaacaaaatctgtgacgacttctaccatttattgagtgcgctacatgttaagtacatcacttggcattttaaaaagacaaaataataaaagtatcttcaagtggagggaataaaaagtaatgtatttgaaaaga

SEQ ID NO: 12287 - DNA, 748 bp, Homo sapiens
cagcgtatttatggtatctcggtgactcctaccttaaccctgttgacttttaagatttcaaggcaaattgagttaggaatctcttcctagcaagaaggccttgtaagtaagaggtccttaaaaataaaagaaaaaaacctaacatgtagactttttctctgcagccccatgtcctggaaccttctgcttttaacctgttaataatggagttatttcgtattgcagtttgcccagttttgtgccaaagagctcgtttttcatactccttccccagacatgaccttgtaaatctttgccggaggtaaaggattagcgtggctgagcagttcgagggagtgaagtgtcttatctctataactttccaaagtggtcctcttctgtgtggtgggtaggttctgtggtattagagtgctgtgtttcagtgatagtgtagcctgctcgatctctaaagtctctgcttagtgttgtttctatataaaaaaaaaaaaagaaactgtggctaccaaccaacttataaacaagttgattggaggcaatccttatttactgtgaggtaagccatgtaataaaatattttaaagctaatgtagcatatcaatttataaaacaagccatgtgctttatcttattcagtttctcccaatgtcagagtgatggttcacaattgtgaatggtgattgagatctggaatgaattcaccagtatttttcaattgtctttttgttgccgtggcatggttgatgtgctt

SEQ ID NO: 12288 - DNA, 384 bp, Homo sapiens
ggatgattcattgagtctatttcaccttatgttatagaggctagcctatcaatgtaaggactgtggaaactcatatgcaattatatttctggttggtaagtgatccaaaaaagatgtaaaagattatttatcccgttagaaaatgaaagtctaggtgggatggctcacacgtgtaatcccagcactttgggatgctgaggcaggcggatcacctgaggtcagaagttcaagaccagcctggccaacatggtaaaaccccatctcgactaaaaattcaaaaattagccaggtactcgggaggctgaggcaggagaattgcttgaacctgggaggcagaggttgcagtgagctgagatcacaccactgaactccagcctgggcgac

SEQ ID NO: 12289 - DNA, 564 bp, Homo sapiens
aaagcttaaatcaagaagaaatatttgatttgatttcttaaatgtcttctcaccatctacagataccatataatgatttacgttaatagaattgttaatattaaaccatcattgcatttctagaacaaactcacttggtcatgctttctatttgctaatattttatttacataatttaaaatctagattataagtgagtctcataagaaaatctgtagttttctttgttagggctatctccgtcaggctttggaatcagcgttatgctggctttgaacagatacatgtgtaagtttccttactttgctctggaatatttcagagggcacagagttttatttcctgaagaattaaaagaatttgcctataaaactgttagggcatgctgctttgagcagcatgaggagtagctgataattagtttctcaaattttttctttggttatcagtctatgtaatttcctatattcttctcctaagtcaaattttgttacgtatattcaaaatatttgtcataaaaatatatttctattttctccctataaagcaataggcagccatgtg

SEQ ID NO: 12290 - DNA, 178 bp, Homo sapiens
cccctaccccactcccagcccttccgtttccctccacgtccccttcccgcgccctcccccacttgaattcttcctcccctccggctggaagaaaagtcggtaatgagaaaccagttcagtgtcagtcggaggaggggggcagataaccccagagatacacggcaatggagagagaact

SEQ ID NO: 12291 - DNA, 675 bp, Homo sapiens
gtattttttgtttcgttttgtttttgtttttgttttttgagacagtgtattaggccattcttgagttactataaagaaattcctgagactgggtaatttataagaggtttagttggttcacagtgctgcaggctgtacaagaggcatagtgccagcatttgcttctggagagtccttaggaagcttacaatcatggtgaaaggaaaagggggaggaggcacatctcacagcaaaagcaggaataagagaaagagagtatggggggaggtgccacatactttaaaatgaccagatcttgcaaaaactcacttggcaccaaggggacagccctagccattcatgagggacctgcccccatgatccaaatacctcccaccagttattacatttcaacatgagatttgggtggggacaaatatccaaaccatatcagactgggtcttaatctgttgtccaggctggaatgcagtcacacaatcacagctcactgcagcctcaacttcctgggctcaagcaatgtcctcatcctcctacctcagcctctcaagtagctgctattacaggcacacgccaccatgcctggctaattttgttgcttttgtagagacaaagttatataccatgttgcccgggcttagctagttatttttaaaaggcttctgaatttcctctctg

SEQ ID NO: 12292 - DNA, 371 bp, Homo sapiens
cacctgagtcctgtacctccgtgtccacccccacacccagtctgtcctccccctagccttccccatctcagccacagcagcagagcccctagaaactccggggaaacccaatcatcagttttgactctcttctccctgtacctctcatatctcatccactggctgctcccgtcaactgttttcaaaatacactgtgagttcaacgaccacttctcccactgtcaccctgaacgaagccaccaaccgctctgacccaggccactgcagtggtttccctgcttaagccactctgcctctctactcagcagccagaagcgctttttaaattaaaatgtccactggaacatgtcaatccctggtgaaaatagccc

SEQ ID NO: 12293 - DNA, 440 bp, Homo sapiens
cacactgctctcctgctggtggaactggcagggctggttccttgttcttcttcttttgattggcatgtcactttctcagtgaggttttctcatccatccatctgcccacccatccatctgatgtctttgctgggtagacaggagtaaacaagtcaaacgcagccaggcgcaattgctcatgcctataatctcagcattttgggagggcaaggcaggtggatcccttgagccaggagttcgagaccagcctgagcaacatggtgagaccccatctatacaaaaaatacaaaaattagctgggggtggtggtgcaccaggaggctgaggtaggagaatcacctgagcctggggaggttgaagctatagtaagccatagtcatgccactgcactccagcctgggtgacagagaccctacctcaaaaacaaaaacaaaaacaaa

SEQ ID NO: 12294 - DNA, 581 bp, Homo sapiens
agatcaaatgctgatttcttcatatatcacaatacatacaaagtcagtgtaagaaagtgttgctaggaagaaatgactttttctaatcccactcctatccttatgtttataccaagtttatagagttgaaactatgttgttctactactttaagccctcctatttagacttaaaagctaggatagatacaaggtatgtggggcaaaatcataggtagagattagtccctaggactgcatcctcgtctcctaccctctcctattattttcttctctttactctccagaattctgataatataagtactggggccagcattcagcttatggttttctactcaagctgtcttgtctcttgtctctgtgtgttttttcgagtatgtcaacagagaagacttcaagtatggtgtggtataatagagaatatagctgatctttatccctagttgctgacacagcttcaaaaaatcttggaatttcctgtgtgacaggagtatctttgttatgctaatgaagtgacttatggtgggcccctagatagcttcaggatggggactggtcaccagaaggaccaaccatgtg

SEQ ID NO: 12295 - DNA, 558 bp, Homo sapiens
cataaacattccaaccatagcacttaagtcacctgctgtgtcccctttcatcccttgtttttcaccaagtagactggctgctcccagagggagaggccatgtctgatttacatcagggctgtcacagatttacacagagggaatccgtggcaagtcccatcactcccactcctggaacttgagtaggtcatctcacctctctgagccgctctttctgataagatttggctctgtttccccacccaaatctcatcttgaattgtaattcccacatgtcaggggagggacacgtaggactggacaggcgggaggtgattggatcacggggtcggattccctcacgttcttgtcgtgatagtgagttctcgcgagaggtgatggttttaaagcgcggcacttcctcattctcgcacacacgccctcctgctgcccatgaagaaggtgtctgctttcccttcgccttccgccatgattgtaagtttcctgaggcctcctagccatgcttcctgttaaatctgcagaactgtgagtcaattaaacctctttcttttataatta

SEQ ID NO: 12296 - DNA, 258 bp, Homo sapiens
cccaatatttgttaaaaagatgattccttctccactgacttacctttggcaaaaataaattaatcagaaatttgtaagcttatatctgaactttctctattccactgctcatgtgtctatccttttgccaatacttatgtttatttagatcttcctcaatgtttgcagttttcagcatgcaattcttacacaaatcttatatctgaactttctctattccactgctcatgtgtctatccttttgccaatacttatgtt

SEQ ID NO: 12297 - DNA, 570 bp, Homo sapiens
tcgtgatcctcccgcctcggcctcccaaagtgctgggattacaggcgtgagccactgcacccagcctctttttttttttgagatggagtttcgctcttgttgcccaggctagagtgcaatggcatgatcttggctcactgcaacctccgcctcctaggttcaagcgattctcctgccccagcctcttgagtagctgggattacaggcacccacgaccatgcctggctaattgcatttttactagagacaggtttcaccatgttggccaggctggtctccaattcctgacctcaggtgatccacccgacttggcctcccaaagttctgggattacattttttttttaaagaaagaataaattaattgtgattaaagttgaaatcaaggcatagtctttccagtctaatttttactgtaatgcttgtatgtcaacagttatgaaggccaggcgcggtggctcacgcctgtaatcctagcagtttgggaggctgaggagggtggatcacttaaggtcaagagttcaagaccagcctggccaatatggtgaaaccccatctctactaaaaatac

SEQ ID NO: 12298 - DNA, 357 bp, Homo sapiens
gatacactcgagaatttctagcgaaagaaaaaaatgaagctaagaaagtggtcgataagtaacaagaaagtgttaaacaaacttgtaaaattataagttaaatctaaaaagttgttgatagcacaatggaaaaaataattaatagaactaaactaaaactaaaatctcaaatgatcttaacatagtggctttggaatggggggataggatatggggaaagtgaaagtagactaatttggaattgtgtcaaatcaataggtaactatccagggagagtatagagatgttgactaataccagatattcatagaaaaatatatgcttaaatgtgtgttaaaatttaaggataatcaccaa

SEQ ID NO: 12299 - DNA, 848 bp, Homo sapiens
acgtgcatggtatttttatcttgacctttgttttgttttgttttaatggtaagtgctactttgtgaaaacattgttgcctttgactgtgttattctatttaaactagcttataagtagatattcacttcagttgcagtatattaaaatactaattggaatcatgtactttaaatatatcaagcagtttctagtttaaattagtctcattaaatactcctttaggttactgggttatatatttcagcttacagaatttgtggaaaaatagtatatatgttatttgataaaatgattcagtttccttatgttttagagactgtcactcatgagtgacatgaaaagaagtagtgagtgagggactcttactctgaatccagataaaatgttcgtagcacatccaatcataaacatcaaaatataattttccattttaatacttccttccttctcttttgtgtggtggaggtggcaaagagaaggtgaacacatgtagcatcgactttttcctctttaaaggacttcttttgtggcttgaatagatcgtggatattaagcaaaataaataaatttacggagcttaattttaatcagtttggctggtttcttacatattttcttgggtttgttggagtccctttccgtatgacttactagagaattctaaagagagtttatgatttgaagcaaaacatgttaaaacaacagctaggattcgagacccagtacaatcttgtttttacatacatgtatttaaaagcttgaacccgggaggcggaggttgcagtgagcggagaccacatcactgcactccagccttgcaacagagtgagactctgtctcaaaaaaa

SEQ ID NO: 12300 - DNA, 1709 bp, Homo sapiens
  misc_feature (46)..(46): n is a, c, g, or t
  misc_feature (404)..(404): n is a, c, g, or t
  misc_feature (476)..(476): n is a, c, g, or t
  misc_feature (497)..(497): n is a, c, g, or t
  misc_feature (666)..(666): n is a, c, g, or t
  misc_feature (675)..(675): n is a, c, g, or t
  misc_feature (859)..(859): n is a, c, g, or t
  misc_feature (1066)..(1066): n is a, c, g, or t
  misc_feature (1170)..(1170): n is a, c, g, or t
  misc_feature (1178)..(1178): n is a, c, g, or t
  misc_feature (1184)..(1184): n is a, c, g, or t
  misc_feature (1193)..(1193): n is a, c, g, or t
atataaaatgctaaataccttcttaaattctttgtaaaatgatatnggtataaatatataaattaaggttaaataaggtgggaaagttaaattataaaatctaaaattacggaaaaatcaaaatagactagaaaagttaacttgatttttaaatagaaatcataaagaaaaataagaaattatgtctctacacagtataaagtgagaataaaacaatagaaatatgacacttcttcaagagtctgtgatattttaaaaataccatcttcaacagaaatattgacaaaacattttccagaagaagaaactaagttaaaatgtagaaatgtgcattcttgtaaatggtagtgaaaagtaaactaggaaatctattttttaaaagtaattcccaatgacatcggggnttttttttgttttgttttgttttgttttgtttttttaataagagacagaatctcactctgtaacccaggctngagtgcagtggcatgatcatngctcattgtaacctcaaactcctgggctcaagagaccttcctgcctcagactcctgaatagctgggactacagccacatgccaccacgccaagccaatttttaaattttttgtggagatggagtctcactatgttgcccaggctcatctcaaactcctgcgctcaagcnatcctctcncctcagcctcccaaagtactgggattacaggggtgagccaccacacctggcccaatgatatcatttttctaaacaatgccttctttgctgttaacattgtaagattgtttgtatactttaaaaggagcaaaatggtcatatgtgggaacagccatagagattcatttcttttgaccaaataatnccactcctattaaagtagacatatatacaaaattatttattaaagcactttttgttagagggcaactgacatatctaacatctggggagtagtctaattgtcatgatacatcacgataagagtcctatgtcatcattaaaattggaacaatgaggccaggcacagtggctcacacctataaatccaccactttgggaggacaaggcnagaggatcgcatgtgggcaggagttcaagactagcctgagcaatatagcaaaatcctatttctacaaaataaaaaataaaaaatgagccaggcgtggtgacatntgcctgtngtctcngctactccngagactgaggtgggagggttactccagcccaggcattcaaggctgcagtgagctatgatcaaaccactatactccagcctgggccacagggtgatcctgcctcaacaaacaaggacaaaattgtaacgatatgtagttagacaatatatacaatcctatacattttgacaaaattgtagcaaagaatatgtagttagacaatacatacaattgtataacattttgacaaaattgtaacaatagtttgacaatatatacaattgtataacattttgacaaaattgtaacaatgatatgtagttagacaatatatacaattgtataacatttaatgttaaataattgcaactgtaaaatacgtatatgtgaaggggatctgaaaatcaactgaatcaaaatgtaaggattactgccactttaaaaatttgctcaaatttatgaatcttatttcactttttaaaatcatgcaaatcatctaagatgctgggacacattcctagccttcccctctgtgcc

SEQ ID NO: 12301 - DNA, 833 bp, Homo sapiens
taagtaaaatgttttctttttttcatttgtctttatgatgtactagtattcaagatttgaaggaaagaattagacagcgtaccaacttaccacttgggccaagtatcgatactcatggggagacttttctatcccaagaagtggtggttaatcttttacaagaaaccaaacaagccttgaaagtatcataaatatatcattcttcaaattgattgtgatgaaaggaaataggattctttctccttagaattttcactgatctataatgggatcaaaaaagtagaaaaatcagtctgcagaatgaaaacagattaatgaaatagctagaaaggaggggagagcatttgtttagttaaatgttaaggtaacttgaaaattgtctatgaaatgctaaaactgtaccagagccttattgcacactcaacattttaagcctgggagcaggggaaggtgggaaaaggttggagtgatagaagtgtttgccttatgatctcttgactccttttacacaagaagcagattggtagagcttaagcaggtgtctgtgctgtggtgctggctctgccaaaaactctcatgtgccctaggaaagttcctttaacttctctgagcccgagtttatctgtaaagtgaagactttttaaatttagtaatctgtatgtctcatctctgagaattctataatgttttcacattgttatatgtgtatatgtacatgttgctcccctctagtcactaagatgccacatatttctacttgagtgaacagattgcaagtccaaatgttcttgtttctaatactaataattgatctcagcaagacataaaaaagt

SEQ ID NO: 12302 - DNA, 912 bp, Homo sapiens
cccagattttcttatgcaggaaagaaacatgaagtaagatttaagccttgaaagtatcataaatatatcattcttcaaattgattgtgatgaaaggaaataggattctttctccttagaattttcactgatctataatgggatcaaaaaagtagaaaaatcagtctgcagaatgaaaacagattaatgaaatagctagaaaggaggggagagcatttgtttagttaaatgttaaggtaacttgaaaattgtctatgaaatgctaaaactgtaccagagccttattgcacactcaacattttaagcctgggagcaggggaaggtgggaaaaggttggagtgatagaagtgtttgccttatgatctcttgactccttttacacaagaagcagattggtagagcttaagcaggtgtctgtgctgtggtgctggctctgccaaaaactctcatgtgccctaggaaagttcctttaacttctctgagcccgagtttatctgtaaagtgaagactttttaaatttagtaatctgtatgtctcatctctgagaattctataatgttttcacattgttatatgtgtatatgtacatgttgctcccctctagtcactaagatgccacatatttctacttgagtgaacagattgcaagtccaaatgttcttgtttctaatactaataattgatctcagcaagacataaaaaagtaaaaaaaaaagtaatcttaccttttattttgaccttggctttaaattattatgatttatcatttcatctttgaatgctgagtgaattacctaaacagaatgtctgttccagttaatcttctctttaaatttttgtagtttaataaacatgtaacaaatcagaagcaagtatatcatgcttatcgatgaactgtagcagattgtaatgg

SEQ ID NO: 12303 - DNA, 275 bp, Homo sapiens
gaagtttaggacacgaagaagaaaagtaactgtttagagtcatatagatagcaagtagaaggttttcaaactcaaacactctgacactagaattcagattttaaccacttattatactgcctctcatttctatacataattacagtgaattatgaatatattttataatccctagactataagccagaggccaggaactgttgttttagtttttcctgcaacacatggtctaatggtattcaatatttatggtaagtataaatgcttaaaatttt

SEQ ID NO: 12304 - DNA, 1214 bp, Homo sapiens
gtagagttgcacagtagaagagggctgcatgtaagaaggcagttctgtctcagaggacaaaaggcctgggagcacccagacagacagtcactgcatggaggtcactcccctcccagtggccactgtggagacatttcacagaaatgcttgctggaccattcaggttcagagttgggacaaaaccgagaactcatggggatattggacaggagttaggaaatgaccttctcacacaactggggcagtgggggagaaccctgggcttgagacttgcaatccaccacttgcccctgcccctgcccctgcagtgtggccgctgttaccttttcctgcaactctgccttcttgagtccaaatgtcttcgaaaggggcaaatgcttcgtaagtgccgacagggtgtgtttcagtgaatgtttgcagtgtgcaccggtctggctgaaggcctcttcccttccccaacaccctcccatcgtgcaaaattaccctgcccagcagggagtgacttgtgtgtctcagaagattttgttgctgtgctctgagttctcactcctcatctcctttgaccagtttcttctaatactccccttgttcacaacacagaacatgagtgctctttcctatcattttgacactaataaacggacagtgattctcagtgtggaaatgagaatgaagttttttttaaagacaggctacaataattcccatgcagagaaccacatgcgatgacactggattccaaacagcaagaacgtatggtgaagatgaggccaacagtgagctgagagaggccagccagggtgtgtttcagtgaagatgagaaacaatcagataacacctgtttcctccaggaaagaaaatgtggccagggaaaagagatgggaggaaggctggtcattgcctattccactgtgcacagtttgaatttggagccatgaaaagtattgcttggttaaattaaaatcattcaaaagataaaacataaacatttaacaccagcacaatatgctgggaaacaaaatgaaaggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggat

SEQ ID NO: 12305 - DNA, 386 bp, Homo sapiens
tgattacaaataaaatatgcaaacatcttacatcttacatctatttttctgtaaattaaaatctgtaaataaagctcagattaaatgagaaatagaatattttatttgatcaagtttcaacataatcgtttcagcttttatgggattaaaaatagtcaatcaaaaatattcattgagatcctcacacatttaaggtgatgatttcagtgtcacagggatgcaaagaactataagaccaagcccctactttccagagtttttatttgcatatttttatttatatattattctgtaaaagccaataagtattaaatgccaaagagaagtattcttctggtttaaaaaaaattgttctgcatgttcatagtcaagaaggatcaatttga

SEQ ID NO: 12306 - DNA, 449 bp, Homo sapiens
ggctttgcaaccttggggcagttccttatatatctctgaacctccgtttcttcttctgtaaaacacaggcaagcaatgcttgtctcattgtggtcttgtgcagataaaataaaagaatgcaatgttctacagtagtcattggtgaaactagctcaatttgttacttttctagtgttaaaagatgtgaattttaaaatgagtatttaagtaaaactaggaagaaatcctgggaggagatagaagaaactgattgtgatacagagtaatcagggatggggtgacactttttactgtatacctttttatgttttaatttttagggccaggtatagtggctcatgcctataatctcagcattttaggaagccaaggccagagtatcacttgggcccaggagtttgagaccagcctgggcaacacagggagaccccttctctacaaaaaataca

SEQ ID NO: 12307 - DNA, 356 bp, Homo sapiens
tcccagcagagaaatagtgaacattctaggactgaaaattataatatcaaacaaaaaaattcactggatgagcttaatggtagaatggagatgacagcgcaagagtcagattaatgaaagatcaatagacattattcagtcttgaaaaaattgtgaacagggatgcagggatcagtgggacaatatcagaagctctaatacatgttgtcataggatggggtgggggtgaatgaaaaaataatggctgaaaatatcccaaatttgatgaatgatataaatgtagagtcaagaagctcaatcattaagcaggattaatttaatgaaaaccacacccaggcgcatcttggttaaacttc

SEQ ID NO: 12308 - DNA, 1796 bp, Homo sapiens
  misc_feature (917)..(917): n is a, c, g, or t
  misc_feature (938)..(938): n is a, c, g, or t
  misc_feature (959)..(959): n is a, c, g, or t
  misc_feature (1023)..(1023): n is a, c, g, or t
  misc_feature (1040)..(1040): n is a, c, g, or t
  misc_feature (1062)..(1062): n is a, c, g, or t
  misc_feature (1068)..(1068): n is a, c, g, or t
  misc_feature (1071)..(1071): n is a, c, g, or t
  misc_feature (1073)..(1073): n is a, c, g, or t
  misc_feature (1081)..(1081): n is a, c, g, or t
  misc_feature (1093)..(1093): n is a, c, g, or t
  misc_feature (1106)..(1106): n is a, c, g, or t
  misc_feature (1147)..(1147): n is a, c, g, or t
  misc_feature (1157)..(1157): n is a, c, g, or t
gttggtcttggactcctgacctcatgatccacccaccttggccttacaaagtgctgggatgacaggcatgagccaccgtgcccggccggtcctgctttctagaaaaaactgtagtgcgcgctccagagacgtaacccgttcccacacctgagtgggcaactctagcctttgaacacagccctaggaaatgactgcaaacgagggggaagctttttaaatacaaggaaaaaggcatttgtaccaagctacatcgcagtgaaattatcattggaaaacagtggaaagaggctgtgtgtccccccacgggtcaggcgcagtcccagggaggtctagaccccaagagcagagaggcctacgggaggcacggcttgtgccaggaggtggggtatgcggccaccaggcactctagttacacagcgatgggctgaaggctgtgcatcccgcagggagtgagccctccgaccctggaggagttcaagcagctgcttgtcaggatgcagcgacaggagggacaccgttgcagccgatgcccgagacagccagaggctgccggcatccagcagcagagaggctgggcctggaatggacccccagaagctggccagaggcctggcagttgggaaaggctcggtcgtcctggggagggagcagcaccagcggaggccccgcctgggtcttcatcagagacactccaagctggtgggggattcctgggacagtgtcacccccggcaggccccaggtgcccaccgcccacccggccacagtgggagcagctcgggtcagggaggccgggctgaatgcaaaccactgctgaggagacaaacgcggcgccacgagcaggtcaggagagaactccctcccgcgggccgtccgcggaccctggcgtcagccagcatgtcctgagccacagacgangctgtcccaggtgtgaaaganggtctgtgcctccgagtggangccggtcccacgctgtggactgagctgcatccctcagatgcatctgtttcagccctaaccccantgtgaggggacgtggangtggggcctcaggggtgatganggttanatnangtcagganggaggagacgcnaacacaattggcnggaccttgatcttagacccgcagcctctagaacctgcaganaatgctgganctgcccagggtgtgattcttgttacgtctccccgagctggctgagacatacagctccactccaccggcctgtgcccagagaccccggggtacaggaggaggacgccgcagaggtgcgtgttgatgagtgggtcgcaccagggtggagcctcctagaagggcagggacgcaccatccttggggagtggcctggagaggcctcgggaagggggtccagggtggctgagcctcagccatcaccccatgccgtccagccctgcaagcacatgctgtgccttggacctgccttctgacggggccggggtgcccgtggggtcccagtccccgtacgagcatctcactttcccttccatggtgctgctggtggccgggagaccatatgtcccagccatagtggcagatgctctccaggccggctaggggacaccggccctcatggcaggtgaggaggcagtgcactgttttgggggctctgaagcccggcctgcccgacttgaagtgtccagggcccaccaccttccttcctggttgaggagtttctgggagaatggtcaaatccccaatgtatcaactcagctttatctccaaaacctaccacttcccagagaacaaaattaaagaagatttcccagaaaaatgt

SEQ ID NO: 12309 - DNA, 408 bp, Homo sapiens
gaaaatttgctctcatattctagcctccttagctttgctgtgctctgttcagtgttttcagcttagcaatcactatgatatcttgggtttctcttccttatgctttagtctagaattaatgtccaaataaaaataccagtcaatcattggaataacctcatttgtttctcttgttcagtgattacagtcttgcattaccttttttccaatctctgaaaacagttttttcatacatgttgggttttggtaggatgactactccagtaccatactccatatggcctaaataaatagtcacttgaaagtatttttctaaattttaaatttaccttttttttttttctaccccatgactttttgaaagtgttttaatttggcttaaccacagttacctttatcatttattct

SEQ ID NO: 12310 - DNA, 409 bp, Homo sapiens
cctcccacccaccccccaattaatccctgtgtcttaagacctcagctcaaatgtgactgctgagggaaacttccccagatgcgccctccccagctaggttagatgccgttgagcatcaagtctgcccaacattattgatctcttgagcacctacagtttcacttcttgggatggagcaaggaggccctgttctgaaggagcttaccatctggcctgagagggtgataaagggaagaaaaatgtaaacaaggttcaaactttgataaatgccattaagaaaagtggggtgatgaagttatcattgcactctgttattttccttcatggctatctatcacaacgtgtaattagttgtgtgtgtgtcattatctgatgaatgaatgtcactgtttcccccataacacagtgc

SEQ ID NO: 12311 - DNA, 376 bp, Homo sapiens
ttctttgcatagtcagatgtcaaatatgacttcaaataatccaagaatattgggcaaggaacttcaaaagagtttggctcagtatcgtatctgtagcaaaattagagtttagtacatagctatctcttttgttgcttaaaaccaatctctctctcttccccccacacacaaaaaatccagtatcttaaattttaaagttatcctcctaagtgctcataaaccaatatatgggaatatagttcttgaaatctgaatggctggttgatgtatgaaaatttgataactcattaaaaataacttgttacaaaatattttctgtatgtacaatctcatataatttctacatggccttgtcatacatcttatatagatggga

SEQ ID NO: 12312 - DNA, 819 bp, Homo sapiens
  misc_feature (233)..(233): n is a, c, g, or t
cattcggcactaggctcagctcactgcaacctccgcctcctggggttcaagtgattctcctgcctcagcctcccgagtagctggactacaggcacgcgccacaacacccagctaatttttgtattttagtagagatggggtttcaccatgttggccaggatggtctcgatctcttgacctcgtgatccgcccacctcagcctcccaaaatgctgggattacaggcgtgacacncgcgcctggccagggctaccaatcctttggggctcaaaagatggttatgtgtgtcacagtgtacatcttgggaatgtgcttctattttgtttccttttcatttgtttagtatcagcctcttccaggtatccttttttaaatacctgtatcaagcatgctatgttatttaaattttctccctgaagattacctaagaatatcacctgaggaaggtgctattggcctattacaaatacagaaactgaagctgaaaggttaagcaccttccccacgttcagacagctcaatagcggaagagatggaatataagccctattcttatttcacaaagctgcctccatgctggggcaggtaacgttaaccctaggaaactgcccaaaacccaccaaaagagagaagctcctagggaacagagttgagaatgttcataccctgcccctgccaactgccggtctgcttggttttgtcacactggcatttctggctttggatgaatcaaaggtggctgttactatgctatactccatccttggtacacagagcacctcgccaggcctctcccccaccatcacatccccagtttcca

SEQ ID NO: 12313 - DNA, 614 bp, Homo sapiens
agccgcgggaatatcagtatggtgactccttaccctggggaagtgtacttaggccacggctaggtgaagcccagggatatttctgttcgcccatgcatccgagaaaggagtgttagacctgaccctgttgtttctcccagcagtgagaacgtggccatggacaagaattccaagtagtggcacttctgtagacgacgcggcccttttggggttactacagcccaggaaactcacatgcgacacggcgccagtgaagtccatctagacccccgcagacccaaggtcacaagttgagaaccccctgccgtggacattcttctgcacctagtggtgaagcaggtggagctgcaccttgctccgcccatttggagactggttctgcacatatgagtgtgccctgcagcgatcctgcaatccttcgtgactaacaaggactttctgtgaaaacagatttatcttttcttctctacctttaaggtttcttgctgttgagaatagttaagggacgaggaattcttattgcccccattttacaggcaaagaaactaatgctgaccccaaccttaccgaccacttggaggtccctaaaaacacatgacctttgtgtttctcgg

SEQ ID NO: 12314 - DNA, 899 bp, Homo sapiens
tatagtgtcagtaatccccagggtgtttggggctcagattgcttcctcagagtatatatgcctctaacctaccacttcaataattttctttccttttttcccccgttttttttgtgttttgtttttaaataacgatgccaggagacagaaaaccaacacctactccagaagaggctgttgagattactgctggaataagcccaggataaaatctttatgtcctttcagacaaagcgtagattaaatagtttatctgactcatacgactgcagtttctttcggcctcatccagaaactgatacaaagttgtttttttcttcttcctttttctggtgcttctataatcttagcttatgctcagctgtgaaaaaagtaaatgtccaggcaggcactctctgcaacatagaattaaacatgcttcctgaacattgtttgcactttcatttgacagagagcagaaatacaggtttatgtatccataaatcctgtcatggttgacaaagtaatttaatagtgttttgactcagaaccatccgttaatacgatttgagagacagagtagagtgctcgtgtgtgtgtgcacgtgcgtgtgtgcaggactggatggggtgggtgcagggcaggaagcatgtgacagaacaccaccacgctgcagtttcacaccctccctgcagcaataggttttaactgaaaagctactactcatgctttgcaaattgatagtcccactgaaaaaaaaaaaattaaattcttccaaaaaacactctgaggttttcgtgagcagaattggttgtagaaggggaaatagatcatatagcttaggccatttgaaaggacttgtcagttgactattgctggaatggaaccagtgtctagacttgttctttgtgatgccttta

SEQ ID NO: 12315 - DNA, 296 bp, Homo sapiens
gcattggtgcctgcacacttgagtatgcagtcacctctttgcttcttttcagactggttttcacaggaaaagacattcaccaattggctcagctagagattttgagagcctctcaaacattttctatggatgtgcatgttccattcctctcttttcctgctgagggagaagtttctgggtggtgtgccttctcctgatcctgaagagccatacaggctgctataaacttcccttctctttttcctaggaaaatgtactgaaagactaggatgcaataccaaattaaaattgtatat

SEQ ID NO: 12316 - DNA, 399 bp, Homo sapiens
gtaagtgggtctatagagatggaaagttacaggttccatctagtagaggctactagtttttgaatagagggagagaaatctattccaaaggaattgcttcctcaatccccactggccactgcttgtgcggtgccaggcaagagggtggactacaggggcaggcagtccagctagcggcacagccattcagtgagtcaggagtctttgtgcaaggaaggctgaggtgatgacagagctaacagcaaactcagacaatctgaaaaagaaaagaaaaaatccagaaaaatcaaccacatatgcagatactgaaaactatttttggtgaacccctttgtgcataagagatcatttacaaaatatgtgtgtgcgagataagtctattcctgtaaagaaatctga

SEQ ID NO: 12317 - DNA, 529 bp, Homo sapiens
caaatagagacgggggtctcactatgttgcccaggctggtctcgaattcctgggtgcaagtgatccccctggcttggcctcccaaagtgctgggattataggtgtgacctactgtgcccaacccaacaggcataattctagcatagtccccagtgactcctgcctcctagtattcagtctcgtgcaagcccctccccttgagtgtgggctggatctaacgacttgcttctactcaacagaatgtgcagtcccttaagtgactaggcttcaaaagatggtgacttccgtctttctagcagactctctctattgccacttcagcttgtgtactttgatgaagcaaggcgccatgctggtgaggcccatgtgaccaagaactgagggtggcctctggccaacagccagcgaggcaccgaatcctgccagcactacatgagtttggaagcagatcattctcagctaaactgtgagatgactatagcccagccaacgtaccttgattacagcctgtgagagattctgaaggacc

SEQ ID NO: 12318 - DNA, 352 bp, Homo sapiens
ttttttttttaatttttggaagtgcatagtaggtgtgtatatttatggggcacctgagatactttaatatagtcatacactgtataataatcacatcagggtaaatagggtatccatcgcctcaagaatttatcatttctctgggttacaaacattttaattatactcttttagttatttttacatgtggaataaattattgttgactgtaatcactatgttgtgctatcaaatactagatcttattcattctgcttttgtacccattaacctagataggtttcttaaattgacctacaatggattttatttcaagcttttgtcagctatattctagtggtgctctcaaatc

SEQ ID NO: 12319 - DNA, 450 bp, Homo sapiens
cctgaggaggaacggtgtcaggattcaagctcctgtctgactgctctgggcgctagtcccaacccaacaagactgaggttgagtgtcccatttctggtgtacagccgctttgggcatctctgcgcttaggagtgtgtgccttattcttaaaaagcaagataacagaggcccggtgcggtggctcacacctgtaatcccagcactttcggaggccgaggcgggcggatcatgaggtcaagagatcgagaccatcctggctaacatggtgaaaccccatgtctactaaaaatacgaaaaaattagccgggcgtggtggcgggcgcctgtagtcccagttactgtagaggctgaggcaggagaatagcatgaacccgggaggcggagcttgcagtgagctgagatcacgccactgcactccagcctgggcgacagagtgagactccgtcttta

SEQ ID NO: 12320 - DNA, 427 bp, Homo sapiens
cagtcagttacagatcggactctttgttctattcttttccctgttctcactactgcacttgactagtcttaaaaaaaaataaaatgaataattaataattgttacataaacatttaagaaatatacctttaatgtgcataccttctaatatcactgagattatgaagcagaattttgtttatattcagtgaagcagttttaattgtatttttcagagccatagactacaatatgtcttggtgagctttctcacaagtgtcagttggtcacttggaataagaaggcaaataagctcagaatacatgattgttaatatgagacacaaagtataattttaatgttttaatatctcaaatataattaggaatgataattcatcataaaagtatatatgctcattatgaatttagaaagctgtaaaaaaaaa

SEQ ID NO: 12321 - DNA, 1090 bp, Homo sapiens
attcaatttaaatatctttttcaagacctgaatccctgtattgtaaagggggaaactgaggcacactgacattaaagtggcataacctaggtgaatcaatagcaacatttccaacttttacccttctctagggtaaaatgcttcactgttgctgttaatctctattactatcctgaaacgtttcctgaaatgataataaacagaaaattttaacataagaaagtaaaagatagatgtaaattacatcaaaactatgtatacctattaggatgtctattacaaggacagagaaaagagaaaatagatgccttgtttggttaggggattatgggcaacatcctttatatgctgcttttaaactaagtcaacataggtttttattgcaggaagaagttcacatttgtgtctaccaaatgacaacatgtaaagtttggaattgagttggttttaggtttttctgtgtatcacttggaggttttctgtgtataactttcttgtattacttggagattttcaggttattggcaccacaggagcagcattattgccagcagacccggggagctggttggagagtcattgcgacttaatttaccctgagctaaaattattatgagtgggccttaatataccagttgttcccacctacacatctagccttgcctttgctgggataaatttgtatacccttcagaggttagattcagaagtacctcctttaggaattatttttagaacctagatctgggtgtagccagaacacgctctgcctactctgttgtagcatgtagctagttggttaacttgatattttccatactccaagtttatcggcagaatgaaacgtttttgtctataagtcttcagcatctaacattgcctctagcacttagaaggtcatctattaagagctttccagagaacattccccaaaaggccgatgggaatatctgtttggtgggtgtctccttattgtagaatggatacaacaggttatcaaacttgacaccattatacattcagattgtatttatcattgtttaagaaatatgtgtcttgtttcctcagttacgggaaaagaaaaaaaaaa

SEQ ID NO: 12322 - DNA, 296 bp, Homo sapiens
cagtattcagtgctgtttgaacactatcccatttaatcttcctaataacctgatgaggtaggtattgtttcattttccagatgaggaaactgagcttctatataatcatacaatttgcccaatcatgtgatagataagtgacattatagggattggaatccaagtcttctggactccaaatttcgtattcttcattatttccctgccttcaggatttgaaacctgatcttgctgcttcctggggcagttcaacccctggcagcctcttgtttcctgagttgtcagattgggagaag

SEQ ID NO: 12323 - DNA, 600 bp, Homo sapiens
aatgttttgacacagatagcatcatctccatttctctacattggcatctgggccaatagtccagtgctattataagtgttttagagctaaaagagaacttctggtctatctggaccagtggtttgtgaaatgtttgctcttcagggattctgcaaacttgaatgtgtttttaaaatttgtaacactccaaagaaccattaccaaaatagtcatcatgaaccctcttgagatgtcatgtagaacacacgcaagaccaccagtgcctcagcctgtgctgccagctttgcctgaatgtgtggagacgccagcctgcagcctccatgccacttctattaactaaagagtattatgcagttgtaaggtggactgagtaaactggttgcgcttgtaactgcttcactgggtgaataaaacaatttgttttcaatatttaaaatcaactaaattcacaaatacatgcatactgagtaagattgccaccatcatccttatcctccaatttcaaattattttggaaaggtctaatttttcttaattgagtttataaattttatacatctacattataaaatacttaataaaagattactttgttctgtt

SEQ ID NO: 12324 - DNA, 341 bp, Homo sapiens
agtcaaatgaatttaaatcatctttaggcttaattctgcagtcttcagatccttggcctctttagaatactaataccattgacagcatatatgatggaacagtactggatgatttcttaagaaagtttattaaagtctgaaaacaagtttttggaatataatagatactttagaaatatttggcctactgaaagagtgaataatcaaatgatcctgtattaaaaatggctattataaatgaatgaaaagtgacttagggctagtagaatagaaatttttgtttttaccttagaggaacatttgtctttaaatgtcattttagcaggattgtatatatgacc

SEQ ID NO: 12325 - DNA, 356 bp, Homo sapiens
atcttgcatctacattggaagccaagaagagtccttcacatgccagaaacaatgaggactttatgcgaagtacagagcatgcaggaccaggttagagaaggaccttcgggaccagcccccaagccacctcgcctgggagaggcatggactcacgaaagcaacagctctccaaaacaggaaagaataatccgattggatccctgggaagcagggtgtaaaactgcagaactgagccaagacgtgagtccctgctcccccatccctcctggccattctaaagctcaacatgcactcaagggaaccgtttcccaacctcgttagcaatcccatcagcacccataaatatgtttctattg

SEQ ID NO: 12326 - DNA, 608 bp, Homo sapiens
ctcccaactcgggagcagaaacgccgtggtccagcaggagaagaggaaacaggcgtttctgctcccgagttgggactgtggaatggtgtgggtgctgtggtctgctccatcgctggctcctccctgggtgggaccttgctggccaagcactggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12327 - DNA, 543 bp, Homo sapiens
aaatacggctagtacgaggccgcgtgttcatgtggtctgctccatcgctggctcctccctgggtgggaccttgctggccaagcactggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12328 - DNA, 1567 bp, Homo sapiens
ggctggtacggcccgggatttggcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12329 - DNA, 1419 bp, Homo sapiens
ggctggtacggcccgggatttggcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12330 - DNA, 1650 bp, Homo sapiens
ggctggtacggcccgggatttggcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggtgagtagatgtagcagggacacaagagagaccacggggctggggctgtgtgggcctgaccttgaccgtgacccccaccccccgccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12331 - DNA, 1638 bp, Homo sapiens
ggctggtacggcccgggatttggcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggaaactgctgcctctgttgaggtcggtgctgcgcttccgcctcgggggcctagcctgtcagactgccttggtcttccacctggacaccctgggggccagcatggacgctggcacaatcttgagaggtgaggggctggccttgaggaggaagagaggggccaggagcctggggcactgctgacttctgccctcccagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12332 - DNA, 1409 bp, Homo sapiens
ggctggtacggcccgggatttggcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggaaactgctgcctctgttgaggtcggtgctgcgcttccgcctcgggggcctagcctgtcagactgccttggtcttccgccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12333 - DNA, 1261 bp, Homo sapiens
ggctggtacggcccgggatttggcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggaaactgctgcctctgttgaggtcggtgctgcgcttccgcctcgggggcctagcctgtcagactgccttggtcttccgccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12334 - DNA, 929 bp, Homo sapiens
ggctggtacggcccgggatttggcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggcgaatcttctgtctggtgcactatggtggcgggctggctggtgacagcctggggtcccagagcccttcgagggtccccccggccttgggactgtaccggcgggcggtgcggggtgtggcccaacatggggcgcgtctcttcgggcaggtgcatggggag

SEQ ID NO: 12335 - DNA, 649 bp, Homo sapiens
  misc_feature (2)..(6): n is a, c, g, or t
  misc_feature (31)..(31): n is a, c, g, or t
  misc_feature (184)..(184): n is a, c, g, or t
tnnnnnttccccgagagtgaaggcagctggnttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggncaagcactggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12336 - DNA, 879 bp, Homo sapiens
ctgcagctctggaacactgaggagagcagggcaggactgagggcccaggtggggagaagggaggtgggggcagatatggaacctcccgtgctcatgccccccccaccacccaaggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggtgagccctccccagtgtaccctgcccacccacttgtacctgagctgcccccaatccactatactgacccatttcccacccccatcccaggaaactgctgcctctgttgaggtcggtgctgcgcttccgcctcgggggcctagcctgtcagactgccttggtcttccacctggacaccctgggggccagcatggacgctggcacaatcttgagaggtgaggggctggccttgaggaggaagagaggggccaggagcctggggcactgctgacttctgccctcccagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggccaa

SEQ ID NO: 12337 - DNA, 885 bp, Homo sapiens
caggttgggggaggccctggctttttcaatgattgacgttgacatcagtcaggagctgggagttgagacctccagggaagtctcgtccggatccatcgctcttctctcaaggagcacagtcctgggaaaggcctagggacctgtgggccggtgatgcgggcactgcagaccaggccaggccctcgggtaaagctctgaggagaggccaaaaccaggcttcaggttcgggaaggtgactgcttgcaactgcagtagcaggaacatgtcaggtgcttactgggtgagacccagccggggaagcctctccaactcctcctagccctggaaaccagacacccagagccccaggctttctcggcacccagaagaagtggggagcgggcaaagcagaaaacattcaatgcatgatgtaggattgctgcgttggcactaagctgttgtattaagcatgagaggtgtttgtttaacgttggcaaagggatttaacaagaaacaaaaagcttcgcgtccttgttttgaccgtcgacagaagtccaattttcttgcctttctttatccccatttctcctccctccccttcccccatcacatccactttcggtcactcgttgttggtatttggtggcagctcttggtcctattgctgtggatgttccactgaaaacacggggggtagcggggagtggtaaggaaagcaacttttttctaatttttgtattggtatccacaagcgtttgtattttttgaattgcaaacactgtgttttctggtctttgggggttagttgaactttctgtattaccttttggaaaacctgagttttaccacagtcttaagcagatttgaaataaattcttttgacactgccaacaacagaaagacaag

SEQ ID NO: 12338 - DNA, 363 bp, Homo sapiens
aaataattttaaatatattttttcaatctttattataataagtaaatttttgtaaaagttgaaatagtagagataactgtaaaattcctcttggctactattttggctatttttccctccaaggtgaaccactgttgcttatttggtatctgttgcttgtctgtacatgggcatgtgcaaacatgtctgtttatattttagagaaaagtttttaaatagctatatggtatcctgctatatgtattctgtaatctgtgtgtcttatttggcattttgttttgaagttattttctttctttttttttttttgagacggagtctcactctgtcgtccaggctggagtgcagtggctccatctgggc

SEQ ID NO: 12339 - DNA, 389 bp, Homo sapiens
ttattccatttacacaaaattctggaaaaggcaaattatcgtgaaaaaaagatcagttgtcttaggcctgagttggagagaaaagattggctataggggagcacagaggaattttgatgttggtaggaccttgcatatttgtatgtatttgccaaacttattgtactatactctttttcttttcctttttttttttttttttttttttgagacggagtctcgctctgtcccccaggctggagtgcagtgacgcagtctcggctcactgcaagctccgcttcccgggttcacgccattctcctgcctcagccacccgagtagctgggactacaggcgcccgccaccacgcccggctaattttttgtatttttagtagagacggggtttca

SEQ ID NO: 12340 - DNA, 489 bp, Homo sapiens
actgaccttttcaacccctggagcagtggatttgcgtgggccctgggcggtgagggtgaaggctgaagggggctgacaccaggcagaggggctcagggctagatgatcctaggagcggtgagccgcgtctgaagtgtggggggtgcatggggtgagtacggccctggttagcagtgactagtttaaggacagctgaacggaggaacccgggatgatggagtcaagactgtggaggtctcagcactttgggaggccgaggtgggcagattatctgaggcggggagttcgagaccagcctggacaacatggtgaaaccccgtctctactaaaaatacaaaagttatctgggcctggtggcgggtacctgtaatcccagctactcgggaggctggggcaggagaatcacttgaacccggaggtagaggttgcagtgagccgagatcgagccactgcactacagcctgggggacagagcgagactctgtctca

SEQ ID NO: 12341 - DNA, 252 bp, Homo sapiens
ataagccatcacgctcagcttcagcactctatacttagtatttgcatgtaacttttgataaaattttataaaggcatataattaaaatttctgaaaagggcaaagttcaaatgtatttaactatagttacaaatacagtattttaaatggaaccaagagaaaatctttcacaaaacatttttaaaggccaacatctaagtttagctctttttaaggtaacagaattacaaaaattattttaaatatcctaat

SEQ ID NO: 12342 - DNA, 1206 bp, Homo sapiens
gagtagccttaattgtggctactgcaaatagaagtcagtgagccaattctgaataaaatcaagtggtatttttagatgaaagtttttccaaaaagtaacaaaactgattttcttgagtatattgatgtagtgatcttttttctaagagttccaaaaatgtttttaatagtgtcaaatgtaattatttctaggttttgatgggagagagagtagatttttcttgaattaagtgtcatgtcagtcttgagtacaggagggaactagaatgagttgtttaatttcagaaccctggtaaaataacctgtctgctctattgcttcttggttgttattggtgtctttaccaaagacttagagtatttcctctaactgtctatgacttgtaggctcctgagtggatggtaatcaaaaggaggaaggaataagttagatatgcatttcattttctcgttgctcatgtgttgcaagatcacttagtacttagaaaaagaactttacagataccagttgatttcacctcttcaaacttatatatcgtccctttacatttatgcttctcaaagatggtcagaaacactgcattttcacccatgtaaggtgtttaagaaacagattcctgaggggaccctctctctccctgcttcctcattgtgtgggccttgggtagggcctaagaatccgctttttttttggtttagactgagtcttgctcttgttgcttaggctggagtacaatggcataatctcagctcactgcaacctccccctccagggttcaagtgatgtctcctgcctctgcctcccaagtagctgggattacaggcacccactaccacgcctgcctaatttttgtatttttagtagagacagggtttcaccatgttggccaggctggtcttgaaccctgaccttaggtgattgacctgccccggcctcccaaagtgctgggattacaggcatgagccaccaagtccagcctaggaatctgcttttcaaagaggtaccacgctggccattaagtatacggagcagtggttctgtcacaggctacatagtttaggcactagatttagaatttgggttgaggccggtcatggtggctcacacctgtaatcctagcactttgggagaccaaggtgggaggatcatttgagctcaggagtttgaggccagcttggactacatagcaaaaccctatctctattta

SEQ ID NO: 12343 - DNA, 576 bp, Homo sapiens
tttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggtcggttccaagtctttgctattgtgaataatgccgcaataaacatacgtgtgcatgtgtctttatagcagcatgatttatagtcctttgggtggagactggactttcatgtttgccagatagtcctggaaacaggttcccctaaccagcactccaaaaacctcctatcccccaacctcaaatcattttggattgagaataatttctcatatctttaaaagcttctagaaaagaagactattagtggaatgaataagtgtttatgccctaaaagaattagtaaactatcctgaatatgtctgtccagtaaaccagagctgaatgagaaaatgctaaaacattcttgcaacaagtcccctaagtttcttctctgcctgaacagcatagttcatcagcctaataaacagagtcaatctcact

SEQ ID NO: 12344 - DNA, 900 bp, Homo sapiens
gcaatatgtgtgcaggcatcgttagaacctttagatatggtctcacttaatctttacaatcgccccatgaaggtggcagtattatctccatttaatagatgaggaagtctagactggggggttaagaaaccaaagttgtaatttttgtttggccaccagtgaaaaatgaaaactctagaccaaatgatggatttttaaactgtgtttctagcagcgcttaggcttagcaaagatgccggggataggaggagctgctgagagggaaggactggccatcggcacctcagttatggcagctctgccttggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggtggccttctagagacctaatcatcattgccatctctcaagacagtctggacccacagaactacgttcaaaagcttgatgactgctctaccacaggcccagatatttgtcttctagtctccttcccacacttgtgcccttaccctctgagccaggataagccgtggtcaagaggaagcagctttgcctggtggatggcatgatccatacacttgtttccccacctcatttcctgcccccccatccatcactttaaaattatgttttgcagtttacaaagtgcttttaagtctactggctccttaagttcccctaagagcattgtgaagtaagcattatccccattttatagacaaggaaactgaggttcatttgattgagttacatgaataaggccatataagtgttgtagaaggatattggtagct

SEQ ID NO: 12345 - DNA, 828 bp, Homo sapiens
ttgggtggtgacatcacgaagtggctggttatgaaaggagcactgtgccgtagaactgaggaaagcacaggctttgctagagatgttaagtattctctctccctgaaagctggttcttctgaaatcaaaatattcaggggggaaggaaaagaggcacagggcatctgaattccaaaggactagggaagccaccacttcccggataactgcactccctccaccttacacctaaaacaaggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggtgagtgcctgccagaggaatgtctgacagctctaccctcaactggatcatctttagcccaaattacaataatttaagtgaatcaaattactatagatacttcattattaattcactggacatttactgagggcctactctgtgccaggcaatgctctgaacttgccctacctattggatgctacgtgctaaatgttatagacaatgtactctcgtacattctataaattatataggatataatgagtactatattctctatgctttacatgctatattcatcacaccctatagtctacatacaatggataatatacaaaatatattatatatgtattatgtctactagaacagtcttttgccacaataggaatttagtaaatatacattgaatgaatgaatgaatgaatatgatacttaataccat

SEQ ID NO: 12346 - DNA, 5881 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccagaaagaatctcagtcatctggactgctttgtgctatatgaaaatctctgagaaccttcaagagcccaaaaacagttctcctccatgctgtatgccatggtcagtggttaaagagaacattttgttccactcctccagctctgccttagaaacccaagccctgcactccaaggctcctggcatcgtacaccagcaccagcaattttctgccaaaagcatcagccaaaatctattctatctatttcagttcctctcttttcatcggattgtatttttacaggtgattgctgattctcacactgctcttcagattcatgtacagctgtggtctgaatgtgtgtgttttctcaaaattcaagtttaaaacttaatcctcaatgtgatagtatcaacagctgcggccttttggaaagtgaaggtggagccctcgtgagtgggattagagctcttataaaagagattgaagggagctacctagcccttccatctcttctgccttgtgaggacacagtgttcatcccttttgtcttcccaccatttgaagatgcagaaagaaggtgccatcttggaagcaaagagcagccctcaccagacaccaagtctgctggcaccttgatcttggacttcccagcctccaggactgtgagaaatgaatttctgttgtttataaattacctagtctaaggtatgctgttacagtagcaggaatggactaagacacacattgtcaaaatcttcatgagttaaaggtgaaggtacaatcagaactggtgcatggaattggaaccataggtcttagtaaacactgtaaaaatgcactattcaaatctacagaaaatgctctctcttcaagttcagaaagaagctacaatctgcttttcctttttttctgaagatgtggggaacgaaattggatcttgtgcttttgggtgctaactttgagccctcttcctttacatctaaatgacaatttgtggatcaatgaggatgtgtcaactagccaagatcgaggacctggaggggtgctctgtggaaactgctttaaaatccttcagagggtgggcacggagctctggttctggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggctaagaagattttcatctttcaccacctgttctggattcttggaacaggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacataaaaaaaaag

SEQ ID NO: 12347 - DNA, 4030 bp, Homo sapiens
ttgggtggtgacatcacgaagtggctggttatgaaaggagcactgtgccgtagaactgaggaaagcacaggctttgctagagatgttaagtattctctctccctgaaagctggttcttctgaaatcaaaatattcaggggggaaggaaaagaggcacagggcatctgaattccaaaggactagggaagccaccacttcccggataactgcactccctccaccttacacctaaaacaaggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacataaaaaaaaag

SEQ ID NO: 12348 - DNA, 4917 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccagaaagaatctcagtcatctggactgctttgtgctatatgaaaatctctgagaaccttcaagagcccaaaaacagttctcctccatgctgtatgccatggtcagtggttaaagagaacattttgttccactcctccagctctgccttagaaacccaagccctgcactccaaggctcctggcatcgtacaccagcaccagcaattttctgccaaaagcatcagccaaaatctattctatctatttcagttcctctcttttcatcggattgtatttttacaggtgattgctgattctcacactgctcttcagattcatgtacagctgtggtctgaatgtgtgtgttttctcaaaattcaagtttaaaacttaatcctcaatgtgatagtatcaacagctgcggccttttggaaagtgaaggtggagccctcgtgagtgggattagagctcttataaaagagattgaagggagctacctagcccttccatctcttctgccttgtgaggacacagtgttcatcccttttgtcttcccaccatttgaagatgcagaaagaaggtgccatcttggaagcaaagagcagccctcaccagacaccaagtctgctggcaccttgatcttggacttcccagcctccaggactgtgagaaatgaatttctgttgtttataaattacctagtctaaggtatgctgttacagtagcaggaatggactaagacacacattgtcaaaatcttcatgagttaaaggtgaaggtacaatcagaactggtgcatggaattggaaccataggtcttagtaaacactgtaaaaatgcactattcaaatctacagaaaatgctctctcttcaagttcagaaagaagctacaatctgcttttcctttttttctgaagatgtggggaacgaaattggatcttgtgcttttgggtgctaactttgagccctcttcctttacatctaaatgacaatttgtggatcaatgaggatgtgtcaactagccaagatcgaggacctggaggggtgctctgtggaaactgctttaaaatccttcagagggtgggcacggagctctggttctggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggctaagaagattttcatctttcaccacctgttctggattcttggaacaggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaa

SEQ ID NO: 12349 - DNA, 5986 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccagaaagaatctcagtcatctggactgctttgtgctatatgaaaatctctgagaaccttcaagagcccaaaaacagttctcctccatgctgtatgccatggtcagtggttaaagagaacattttgttccactcctccagctctgccttagaaacccaagccctgcactccaaggctcctggcatcgtacaccagcaccagcaattttctgccaaaagcatcagccaaaatctattctatctatttcagttcctctcttttcatcggattgtatttttacaggtgattgctgattctcacactgctcttcagattcatgtacagctgtggtctgaatgtgtgtgttttctcaaaattcaagtttaaaacttaatcctcaatgtgatagtatcaacagctgcggccttttggaaagtgaaggtggagccctcgtgagtgggattagagctcttataaaagagattgaagggagctacctagcccttccatctcttctgccttgtgaggacacagtgttcatcccttttgtcttcccaccatttgaagatgcagaaagaaggtgccatcttggaagcaaagagcagccctcaccagacaccaagtctgctggcaccttgatcttggacttcccagcctccaggactgtgagaaatgaatttctgttgtttataaattacctagtctaaggtatgctgttacagtagcaggaatggactaagacacacattgtcaaaatcttcatgagttaaaggtgaaggtacaatcagaactggtgcatggaattggaaccataggtcttagtaaacactgtaaaaatgcactattcaaatctacagaaaatgctctctcttcaagttcagaaagaagctacaatctgcttttcctttttttctgaagatgtggggaacgaaattggatcttgtgcttttgggtgctaactttgagccctcttcctttacatctaaatgacaatttgtggatcaatgaggatgtgtcaactagccaagatcgaggacctggaggggtgctctgtggaaactgctttaaaatccttcagagggtgggcacggagctctggttctggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggctaagaagattttcatctttcaccacctgttctggattcttggaacaggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcggttctggaggctgagaagtccaagatcaaggcaccaacagattcagtgtctgatgaaggcttgttctctgcttcaaagatggcacctcttgctgtgttctcacatggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacataaaaaaaaag

SEQ ID NO: 12350 - DNA, 5714 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccagaaagaatctcagtcatctggactgctttgtgctatatgaaaatctctgagaaccttcaagagcccaaaaacagttctcctccatgctgtatgccatggtcagtggttaaagagaacattttgttccactcctccagctctgccttagaaacccaagccctgcactccaaggctcctggcatcgtacaccagcaccagcaattttctgccaaaagcatcagccaaaatctattctatctatttcagttcctctcttttcatcggattgtatttttacaggtgattgctgattctcacactgctcttcagattcatgtacagctgtggtctgaatgtgtgtgttttctcaaaattcaagtttaaaacttaatcctcaatgtgatagtatcaacagctgcggccttttggaaagtgaaggtggagccctcgtgagtgggattagagctcttataaaagagattgaagggagctacctagcccttccatctcttctgccttgtgaggacacagtgttcatcccttttgtcttcccaccatttgaagatgcagaaagaaggtgccatcttggaagcaaagagcagccctcaccagacaccaagtctgctggcaccttgatcttggacttcccagcctccaggactgtgagaaatgaatttctgttgtttataaattacctagtctaaggtatgctgttacagtagcaggaatggactaagacacacattgtcaaaatcttcatgagttaaaggtgaaggtacaatcagaactggtgcatggaattggaaccataggtcttagtaaacactgtaaaaatgcactattcaaatctacagaaaatgctctctcttcaagttcagaaagaagctacaatctgcttttcctttttttctgaagatgtggggaacgaaattggatcttgtgcttttgggtgctaactttgagccctcttcctttacatctaaatgacaatttgtggatcaatgaggatgtgtcaactagccaagatcgaggacctggaggggtgctctgtggaaactgctttaaaatccttcagagggtgggcacggagctctggttctggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggctaagaagattttcatctttcaccacctgttctggattcttggaacaggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacataaaaaaaaag

SEQ ID NO: 12351 - DNA, 5414 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccagaaagaatctcagtcatctggactgctttgtgctatatgaaaatctctgagaaccttcaagagcccaaaaacagttctcctccatgctgtatgccatggtcagtggttaaagagaacattttgttccactcctccagctctgccttagaaacccaagccctgcactccaaggctcctggcatcgtacaccagcaccagcaattttctgccaaaagcatcagccaaaatctattctatctatttcagttcctctcttttcatcggattgtatttttacaggtgattgctgattctcacactgctcttcagattcatgtacagctgtggtctgaatgtgtgtgttttctcaaaattcaagtttaaaacttaatcctcaatgtgatagtatcaacagctgcggccttttggaaagtgaaggtggagccctcgtgagtgggattagagctcttataaaagagattgaagggagctacctagcccttccatctcttctgccttgtgaggacacagtgttcatcccttttgtcttcccaccatttgaagatgcagaaagaaggtgccatcttggaagcaaagagcagccctcaccagacaccaagtctgctggcaccttgatcttggacttcccagcctccaggactgtgagaaatgaatttctgttgtttataaattacctagtctaaggtatgctgttacagtagcaggaatggactaagacacacattgtcaaaatcttcatgagttaaaggtgaaggtacaatcagaactggtgcatggaattggaaccataggtcttagtaaacactgtaaaaatgcactattcaaatctacagaaaatgctctctcttcaagttcagaaagaagctacaatctgcttttcctttttttctgaagatgtggggaacgaaattggatcttgtgcttttgggtgctaactttgagccctcttcctttacatctaaatgacaatttgtggatcaatgaggatgtgtcaactagccaagatcgaggacctggaggggtgctctgtggaaactgctttaaaatccttcagagggtgggcacggagctctggttctggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggctaagaagattttcatctttcaccacctgttctggattcttggaacaggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaaaaaaataaaaaaaaaaaagaaaaaaatagaaaaataaaaaaaaaaaaaaaagggggggggcgcgtgataaaaaggtttttcccgggagagggggcccgacaatttttaggggtgttaccaacgggttttttgtgtgtaacaaaaagggtggggccccaataaagggagggggggttataattaataagcgaaagcaggagtgggcgaggcggtttttaaacaagcgggcgtgatcgggtgtgggaacaactcgttttgcgggttggaaaaccttgtggggaaaggggaaacccctttacatttgcttggggggggagaacacaatattgggcaaaaaatatcctctagaggaaaagatttttaaaggagttctagggggacaaaattattaaccatttataggtgttataatgttgtctaaaaaacgagggataattatattgtgggcttaaaaaaatggcaacaggagaaatatctttgtgagaaaatttattcag

SEQ ID NO: 12352 - DNA, 2356 bp, Homo sapiens
gaagaccgcgaatccgtgatccacgcctcagctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacataaaaaaaaag

SEQ ID NO: 12353 - DNA, 3982 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccagaaagaatctcagtcatctggactgctttgtgctatatgaaaatctctgagaaccttcaagagcccaaaaacagttctcctccatgctgtatgccatggtcagtggttaaagagaacattttgttccactcctccagctctgccttagaaacccaagccctgcactccaaggctcctggcatcgtacaccagcaccagcaattttctgccaaaagcatcagccaaaatctattctatctatttcagttcctctcttttcatcggattgtatttttacaggtgattgctgattctcacactgctcttcagattcatgtacagctgtggtctgaatgtgtgtgttttctcaaaattcaagtttaaaacttaatcctcaatgtgatagtatcaacagctgcggccttttggaaagtgaaggtggagccctcgtgagtgggattagagctcttataaaagagattgaagggagctacctagcccttccatctcttctgccttgtgaggacacagtgttcatcccttttgtcttcccaccatttgaagatgcagaaagaaggtgccatcttggaagcaaagagcagccctcaccagacaccaagtctgctggcaccttgatcttggacttcccagcctccaggactgtgagaaatgaatttctgttgtttataaattacctagtctaaggtatgctgttacagtagcaggaatggactaagacacacattgtcaaaatcttcatgagttaaaggtgaaggtacaatcagaactggtgcatggaattggaaccataggtcttagtaaacactgtaaaaatgcactattcaaatctacagaaaatgctctctcttcaagttcagaaagaagctacaatctgcttttcctttttttctgaagatgtggggaacgaaattggatcttgtgcttttgggtgctaactttgagccctcttcctttacatctaaatgacaatttgtggatcaatgaggatgtgtcaactagccaagatcgaggacctggaggggtgctctgtggaaactgctttaaaatccttcagagggtgggcacggagctctggttctggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggctaagaagattttcatctttcaccacctgttctggattcttggaacaggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggtggccttctagagacctaatcatcattgccatctctcaagacagtctggacccacagaactacgttcaaaagcttgatgactgctctaccacaggcccagatatttgtcttctagtctccttcccacacttgtgcccttaccctctgagccaggataagccgtggtcaagaggaagcagctttgcctggtggatggcatgatccatacacttgtttccccacctcatttcctgcccccccatccatcactttaaaattatgttttgcagtttacaaagtgcttttaagtctactggctccttaagttcccctaagagcattgtgaagtaagcattatccccattttatagacaaggaaactgaggttcatttgattgagttacatgaataaggccatataagtgttgtagaaggatattggtagct

SEQ ID NO: 12354 - DNA, 987 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccccagccgggtgacttctcatccattggc

SEQ ID NO: 12355 - DNA, 5119 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccagaaagaatctcagtcatctggactgctttgtgctatatgaaaatctctgagaaccttcaagagcccaaaaacagttctcctccatgctgtatgccatggtcagtggttaaagagaacattttgttccactcctccagctctgccttagaaacccaagccctgcactccaaggctcctggcatcgtacaccagcaccagcaattttctgccaaaagcatcagccaaaatctattctatctatttcagttcctctcttttcatcggattgtatttttacaggtgattgctgattctcacactgctcttcagattcatgtacagctgtggtctgaatgtgtgtgttttctcaaaattcaagtttaaaacttaatcctcaatgtgatagtatcaacagctgcggccttttggaaagtgaaggtggagccctcgtgagtgggattagagctcttataaaagagattgaagggagctacctagcccttccatctcttctgccttgtgaggacacagtgttcatcccttttgtcttcccaccatttgaagatgcagaaagaaggtgccatcttggaagcaaagagcagccctcaccagacaccaagtctgctggcaccttgatcttggacttcccagcctccaggactgtgagaaatgaatttctgttgtttataaattacctagtctaaggtatgctgttacagtagcaggaatggactaagacacacattgtcaaaatcttcatgagttaaaggtgaaggtacaatcagaactggtgcatggaattggaaccataggtcttagtaaacactgtaaaaatgcactattcaaatctacagaaaatgctctctcttcaagttcagaaagaagctacaatctgcttttcctttttttctgaagatgtggggaacgaaattggatcttgtgcttttgggtgctaactttgagccctcttcctttacatctaaatgacaatttgtggatcaatgaggatgtgtcaactagccaagatcgaggacctggaggggtgctctgtggaaactgctttaaaatccttcagagggtgggcacggagctctggttctggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggctaagaagattttcatctttcaccacctgttctggattcttggaacaggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggta

SEQ ID NO: 12356 - DNA, 3914 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcacccagaaagaatctcagtcatctggactgctttgtgctatatgaaaatctctgagaaccttcaagagcccaaaaacagttctcctccatgctgtatgccatggtcagtggttaaagagaacattttgttccactcctccagctctgccttagaaacccaagccctgcactccaaggctcctggcatcgtacaccagcaccagcaattttctgccaaaagcatcagccaaaatctattctatctatttcagttcctctcttttcatcggattgtatttttacaggtgattgctgattctcacactgctcttcagattcatgtacagctgtggtctgaatgtgtgtgttttctcaaaattcaagtttaaaacttaatcctcaatgtgatagtatcaacagctgcggccttttggaaagtgaaggtggagccctcgtgagtgggattagagctcttataaaagagattgaagggagctacctagcccttccatctcttctgccttgtgaggacacagtgttcatcccttttgtcttcccaccatttgaagatgcagaaagaaggtgccatcttggaagcaaagagcagccctcaccagacaccaagtctgctggcaccttgatcttggacttcccagcctccaggactgtgagaaatgaatttctgttgtttataaattacctagtctaaggtatgctgttacagtagcaggaatggactaagacacacattgtcaaaatcttcatgagttaaaggtgaaggtacaatcagaactggtgcatggaattggaaccataggtcttagtaaacactgtaaaaatgcactattcaaatctacagaaaatgctctctcttcaagttcagaaagaagctacaatctgcttttcctttttttctgaagatgtggggaacgaaattggatcttgtgcttttgggtgctaactttgagccctcttcctttacatctaaatgacaatttgtggatcaatgaggatgtgtcaactagccaagatcgaggacctggaggggtgctctgtggaaactgctttaaaatccttcagagggtgggcacggagctctggttctggttgaagagtcctgtcaaggccatctcaaaaggagaagcaaagcctgcagaggaggccagcctgagtcctggggtgcgaacgggtgctgggctcagcatgaggaggaggagaccctggccacagttccatgaatctttgctcccttccacattatggattctggctaagaagattttcatctttcaccacctgttctggattcttggaacaggtaaattcattggcctacgcaagtctgagctctaggtctgaacccgcatggacctgagggtgcaccgagaaaagaaaggctgacaactggatcccgggaatgtcaaggccaccctgggcttgaagggaccggccatgcctccaagccttgcccagagagggggttcaggatgctgcgtggttccaggtgatctattgctttctcgagtttaaagttcagaggatcatgaagtaccacagctggaaggggtgtaagtgacactgcctagcctaactctcttaaaaatcatagccctactcctgcctccccaaatcagatacgacaggcataggctctgactgttccttaagtcttagtggcaatactccctgaccagttttgcggggttgctcccagttccattgcttttgtaacaggtggccagaaagcctggggtcccgtgataagagtttcagttctttccaggatggatggaaagaaggaaggaaggatggatggatggatgaatgaatgagcgggtgagcggatggatggatggatggatggatggatggatagatgggccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttca

SEQ ID NO: 12357 - DNA, 1053 bp, Homo sapiens
acagatggcctggatcagtgcaatgtgcaacaagaggactatatcgtctcagtaaaaaccttgaagagatgaacccatttcagagacccagcaagggatcacctgcatatacaggcatcagcagaaacaggaatttgggatttatcctggaggtagtggaagcttttggaggtcttaaccaggacagcacatgtggctttcctgcaatgggatcgtccttcaagaggacctcacaggctctccacccggactgtgacgtaagcagctgcagcagccttggatgtttctggatagccagccccatgagaacagctttaaaataggagactggcattgtgatgaagtgtggacttcgctgtcatatagacctggatttaaatcctggcttcagtgtttatggatgacattggacaagtcatttaacctccttaagtctcagagttctcattacggaaatggagctcttaatagtacctaccccctagtgtggttgtgagggttgagatcatctatgttcaaagtgcttattatacagagacggggacatgtaagtgctacataaatgttagcttttattagtcactggagtggaggagagaggactgttgcctccttgtcaatgtccccatcctgggaagcctgcctgtgtgcaccaaggcccatctgacccatatatcagaaaaggtgcccttctagggagcgacaccccccaccaagccccccagtcgctgtccatgctttcctctaggttcaaaatgcagctgcatctgtgcagaaaccaggtgttgcctgtgagttctgcctcgctggccagaggtggaaggaaggaggaaaggagaggggcctccatacttccagagccccactgggggttaccttcgcttgcccccactctttttgtcttgctctgaggatgccaggactttaaggacattgtcagcgagcacgtaagttcaccccgaaggctgcgccgatgccccagcttccagcagcccaatgctctttggccttgtccaaagcttgctcgctggtcgggagaccggtgggtgggag

SEQ ID NO: 12358 - DNA, 3794 bp, Homo sapiens
  misc_feature (1823)..(1823): n is a, c, g, or t
  misc_feature (2182)..(2182): n is a, c, g, or t
  misc_feature (2184)..(2184): n is a, c, g, or t
  misc_feature (2186)..(2186): n is a, c, g, or t
  misc_feature (2195)..(2195): n is a, c, g, or t
  misc_feature (2203)..(2205): n is a, c, g, or t
  misc_feature (2857)..(2857): n is a, c, g, or t
  misc_feature (2871)..(2871): n is a, c, g, or t
ggcacgaggggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagtngcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgcgtgtgtgtgtgtgtgtgtgtgtgtgtgtgtgtgtatgtgtgtatatatatatatatatatatatatatatttttttttntntntttttttanattacaannnccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgttgttttctttaaaagtcatatnggttcgtggcctantgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaattgccatgactaaatcttttcacatatttcagtgtattttttttatagatttaaaatatacctgaaaacttttctaggaagaataattattcatggaaagagcattgtaatggcatgttttggggagaaaagacatgccaagtcttgtttactacatttaagatgtttacaactatactgggctgctttattaacaatactgtacttgcataatatggcattataagta

SEQ ID NO: 12359 - DNA, 1227 bp, Homo sapiens
ggcacgaggggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttat

SEQ ID NO: 12360 - DNA, 737 bp, Homo sapiens
gagctgagaggcgcgcgtgaacaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctacgaaatggacatttgtctactggaagcttagtgctaaaatggaagaatggaaagtacttcagacttagtgggaactaaactagagaggaggggaacagtcaataagacgagacaagcaccaaaaggacaactgggacatcagctgaaagagcaacagaacgacagagtgcacgactgaaatgtgacgagatga

SEQ ID NO: 12361 - DNA, 3146 bp, Homo sapiens
  misc_feature (1823)..(1823): n is a, c, g, or t
  misc_feature (2104)..(2104): n is a, c, g, or t
  misc_feature (2106)..(2106): n is a, c, g, or t
  misc_feature (2108)..(2108): n is a, c, g, or t
  misc_feature (2117)..(2117): n is a, c, g, or t
  misc_feature (2125)..(2127): n is a, c, g, or t
  misc_feature (2835)..(2835): n is a, c, g, or t
  misc_feature (2849)..(2849): n is a, c, g, or t
ggcacgaggggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagtngcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtntntntttttttanattacaannnccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatatnggttcgtggcctantgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacac

SEQ ID NO: 12362 - DNA, 3649 bp, Homo sapiens
  misc_feature (2326)..(2326): n is a, c, g, or t
  misc_feature (2607)..(2607): n is a, c, g, or t
  misc_feature (2609)..(2609): n is a, c, g, or t
  misc_feature (2611)..(2611): n is a, c, g, or t
  misc_feature (2620)..(2620): n is a, c, g, or t
  misc_feature (2628)..(2630): n is a, c, g, or t
  misc_feature (3338)..(3338): n is a, c, g, or t
  misc_feature (3352)..(3352): n is a, c, g, or t
tacggtttgacagaaatttattgtaattcaactcaatctcattttgtaattgagaatgctgaggctcagggctatgttcatgctttatatactattcacggaatagacaggaaagcggtgggtgattcaataccagcatccctctgtcatcatcggtggaaaatgtctcagtgaggatttccaaaagtatccagggacaaacgtccaggattctagaggaccctctaccttgctacctgtggaactggatcactcattatggttttcatgaattcattctctgcaattgaccggagctgtcaaggacaaacaccccaggctgagccttggtctcatctaggagtggccaagctggggtgggcagggcggtccagggtagacactctgggacagtgggacattgtgacatcatcattggtggtcttggacagtttctcattgctgggtctccactcctagctgttactgcaagtccatgcctctaccatgagggtggaggagttaagatcaacagatccacatgtaccttgaggtgacagactggctctgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagtngcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtntntntttttttanattacaannnccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatatnggttcgtggcctantgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacac

SEQ ID NO: 12363 - DNA, 1729 bp, Homo sapiens
ggcacgaggggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaattt

SEQ ID NO: 12364 - DNA, 3004 bp, Homo sapiens
  misc_feature (1681)..(1681): n is a, c, g, or t
  misc_feature (1962)..(1962): n is a, c, g, or t
  misc_feature (1964)..(1964): n is a, c, g, or t
  misc_feature (1966)..(1966): n is a, c, g, or t
  misc_feature (1975)..(1975): n is a, c, g, or t
  misc_feature (1983)..(1985): n is a, c, g, or t
  misc_feature (2693)..(2693): n is a, c, g, or t
  misc_feature (2707)..(2707): n is a, c, g, or t
ggcacgaggggaggaggaggggagaggcctggaggacaccaacatgaacaagttgaaatcatcgcagaaggataaagttcgtcagtttatgatcttcacacaatctagtgaaaaaacagcaaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagtngcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtntntntttttttanattacaannnccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatatnggttcgtggcctantgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacac

SEQ ID NO: 12365 - DNA, 3141 bp, Homo sapiens
  misc_feature (1818)..(1818): n is a, c, g, or t
  misc_feature (2099)..(2099): n is a, c, g, or t
  misc_feature (2101)..(2101): n is a, c, g, or t
  misc_feature (2103)..(2103): n is a, c, g, or t
  misc_feature (2112)..(2112): n is a, c, g, or t
  misc_feature (2120)..(2122): n is a, c, g, or t
  misc_feature (2830)..(2830): n is a, c, g, or t
  misc_feature (2844)..(2844): n is a, c, g, or t
ggacgcgtgggtcgaccacgcgtcgcggacgcgtgggtcggaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagtngcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtntntntttttttanattacaannnccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatatnggttcgtggcctantgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacac

SEQ ID NO: 12366 - DNA, 883 bp, Homo sapiens
ggcacgaggggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgca

SEQ ID NO: 12367 - DNA, 422 bp, Homo sapiens
agacattgcaagtgttgactctgtgatttaaaagctccatgaccctggaccagttacttaacaatctcaattccttgatctgtggaaaggggattatgatagtacctattttgccaatgagatgcatcctcaaacacttgagatcccagtggctgttacctaccataccttcattatttgactaagaactctttttcgtgtgtttatttctttagtatttacatctgtgaacctcagttttcctattagtaaaatgaaggtcaagtatgacatcttatttgagctgtgagttgacagtgtaacacttctcataaactgcatgcatttgaaatatgaagttgtaaaactctacgattaagctttgtatttctagcaccttggctatactgtttcttattcagttaattgttgcaaaaagaaaa

SEQ ID NO: 12368 - DNA, 419 bp, Homo sapiens
gtatagaaatgcaactgattattgtgtgctgattttgtgtcctgcaactttgctgaattcatttattagttctaacagtacttttgtgtttgggtatgtgttaaatctttggggttttctacatataagatcatttcggccaggtgtagtggcttacacttgtaatcccagcactttgggaggccgagggaggtggatcacctgaggtcaggagttcgaaaccagcctggccaatatggcaaaaccccatctctactaaaaatacaaaaattagctgggcatggtggcaggcacctgtaatcccagctacttgggaggctgaggcacaagcatagcttgaatctgggaggcagagggtgcagtgagccaagattgcaccactgcactccagcctgggtgacagagcgagactacgtctc

SEQ ID NO: 12369 - DNA, 1059 bp, Homo sapiens
tagtaagatttcttgaaacctttgacttagaatgttggctagagggtttcctatactggctttctcctacctgtgtaaatttgagcaaatgtgaatcccagctataacataatgttggactggaacagttctttttgtgttaaactggcataatttctttttttgagtgtattactgtccttggttatgcagtgtagtcttcggacgaattgcattagcatcctcacctagaacagaaatacagaatctcagcctcacccaaacctgaatcagagtctatatccaggtggcttgtgtgcacattaaagagaagcagggtcattgctgtttcaatactaagtcagttgcctaatttttgttagtccatctgttctatttgcaacatacctgatgtttttctcccaagttgacttggagatataaaacctttttgggtggtgcaatctgttaaagttaacatcatagttgtgaatccattctaaggcagaaatttaagaacaagcttcgtcttttgaggaagaccgtaataaaagataatccttcttttaattcgtgtctcttgctttaaagaaaagttaccttgcattatagttaatatttctactggtgtttcctcttagaaacttgagagactattgtcagtgagctgaatgattctgcaaaatcagggaaaagtagtctttagattaataatgtaggattcagaaagtctatagtgtctccctctttgtgggtaggagggaatgggagcagatagaagctaaagataatttatttctgcaggttctggcagtcagaataactggcttttaactttattatgcccgggtacaatgcatattatgtcaaacaaatataacttctttaaatattcacatgtaatcttctcattttgcatgtctagtatttgatgctttgctataaagctacaggtccacaatccctttttcatagaattctgaaatccaaaaagtctttaaaaaaattttttttatagcttccttgatgtggaccttaactgatttgggaaaaaaaaaaaaaaacaaaaaaaacttgacc

SEQ ID NO: 12370 - DNA, 1163 bp, Homo sapiens
atatattttcatcttgacaatgccagaaattcctaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaaggtctcacataacactgaaaatagagtgcgtaacagaagggatctggaagtttcccataatgttgatcgctactgaacctgatacggatgctgtcattgacattgaaggagttggtttatttaaggaatctgtttttgaacttaggctgaaaagtcagacaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagttatgaatgttttttggttgcgaacattggaattggttcacttttaaagtgcaggtgtatatttgtggtaaaacgaaatataatttaaatgacaacagtatttccaataacagcgttgctaataaagctaaatgtctcatgtagatattccttgttagtctttatgttttaattgacaactaaacattgtatatatttatggtatacaacatattttgaatatgcatacattgcagcatggttagcctgagctaatt

SEQ ID NO: 12371 - DNA, 1001 bp, Homo sapiens
atatattttcatcttgacaatgccagaaattcctaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagttatgaatgttttttggttgcgaacattggaattggttcacttttaaagtgcaggtgtatatttgtggtaaaacgaaatataatttaaatgacaacagtatttccaataacagcgttgctaataaagctaaatgtctcatgtagatattccttgttagtctttatgttttaattgacaactaaacattgtatatatttatggtatacaacatattttgaatatgcatacattgcagcatggttagcctgagctaatt

SEQ ID NO: 12372 - DNA, 468 bp, Homo sapiens
cgagatagcgccattgtactctggcctggggcacaagagtgaaagtccatctccagaaaaaaaaaaaaaaaaaaaaaacccacaacaacaacgagggccccgcatgtggctgaaaacaacagaaatgtattgtctcgcaggcctgaatgctagaagtccaaaatcagggtgtcagccggacttcgcttcctctgaaacatgcagagagctgatcaaaacagcaaaagcaaagcagtgcccctggcccagttctgaagccaaccttccttaaccacgcagacccatccctggttaggacttgctgtggattctcaggtgactccatctcaggatacagggactgagagggtatatgcaatatctcagacccagaaaccgttgattctgtctaaaagcacagcaataaccacatcccaccctcttgatttaaatgaaagtgtttgggagaataaaagatgaaccttttta

SEQ ID NO: 12373 - DNA, 567 bp, Homo sapiens
acagctttcgggcctaacctctgccaatcgtgatgtatgccaactctggttacagtatcaatgggagaattaaaatgtgtttcaacaaaggcagccatggctttgataatgtcctcatggatatgaagacattcagagctttcgggccagatttcaagaggaatggcctggccgagccttttaacgacatccacatctacccattcatgtgtaagctcctgggagtcacccccaaacccacaacggctccctggcagtcacccaggaaatgctcgtgaactcttacgaccagcagccaggcagagagctgatcaaaacagcaaaagcaaagcagtgcccctggcccagttctgaagccaaccttccttaaccacgcagacccatccctggttaggacttgctgtggattctcaggtgactccatctcaggatacagggactgagagggtatatgcaatatctcagacccagaaaccgttgattctgtctaaaagcacagcaataaccacatcccaccctcttgatttaaatgaaagtgtttgggagaataaaagatgaaccttttta

SEQ ID NO: 12374 - DNA, 872 bp, Homo sapiens
acagctttcgggcctaacctctgccaatcgtgatgtatgccaactctggttacagtatcaatgggagaattaaaatgtgtttcaacaaaggcagccatggctttgataatgtcctcatggatatgaagacattcagagctttcgggccagatttcaagaggaatggcctggccgagccttttaacgacatccacatctacccattcatgtgtaagctcctgggagtcacccccaaacccacaacggctccctggcagtcacccaggaaatgctcgtgaactcttacgaccagcagccaggtgagacacaaaagcagctgccagaaaactgtcagcagagtctgctctgtcctgagatagaaaagaaacaaaaagtggtctcatggtggggaggagggaattcaagcagaacaatcctgattcccagcagctttggagccctaggaacaagatgtcaacagctccaaacagatagcacgggaggtagggaatccctcgacctgctggtaacatttgacatagtgccttttaggcaaagggaaggtgctctatagagaaagtcgggctgtaatccttccggtcctaaggaaatcactgtgtacagtctgcccccaagatgccccttccagatatggaaatcagccctccttcaatagcacagaaagctcttcataggggaggagaaataccctgttcactcgatgctgaaaaaaggagaggggagagtctgaaacgagactgcaaattctcaagacttcaaaccccttcaatctgggtaatacaaaggaagaataaaatcatctcagaatttgctgttgccttctttagtgggttgtttacaaacactggctatctttccttttgccgggagag

SEQ ID NO: 12375 - DNA, 606 bp, Homo sapiens
ctaaagcgttcagaaattggcacccttctttttaaaaagataacatcatgaatatacagttgacccttgaacaatttgggagttaaaggtgccaaccctctgcacagtcaaatctgtgtatgcattttaatgcccccaaacttaaatactgataacctactgttgactggaagcctgaccaataacataaacagttgattaacatattttgtatatgtattatatgctgtattcttgcaataacgtaagctagagaaaagtaaatgctttgaagaaaatcataaggaggagaaaatatatttactattccttatgtgaaagtggatcttcataaaggtcttcatcctcattgttgtcttcacgttgagtaggctgaggagggaagaggaaaaggggctggacttgctgtcccaggggtggcagagatggaagaaaacccacctataagtagactcatgtacttcaaacccatggtgttcatcaactatatattcagtggaaaaatttacttaatattaaaataaacgtcttgaattatcttcacaagtcactggaatatttgcttgctactaagtatgggtaataataaagctgtttatgttcatt

SEQ ID NO: 12376 - DNA, 403 bp, Homo sapiens
aatgaagaaatgggatcttgggtatgcgctgggattagggtggactactcttgtttcttaatgaaataagattggagccagaattagaaggagagacaggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagtta

SEQ ID NO: 12377 - DNA, 764 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagcttgagcgacagagtgagactctgtctcg

SEQ ID NO: 12378 - DNA, 598 bp, Homo sapiens
cctattaaaagtccaactgcatatgtaatcctactctgtccttcatagaggggaaggagccacagatgacatcccagttctgccctcctagtgcttgtgactccctctcttccagccccacccccatggtatgtatattccttacaagtcctccacaagagcagctgtctaggatgcggggaggggaggctccttcccttagggagcgtggagagaagggagcagccttgttgctgtatttttggttttgtttcagttgggcaggcatgggatgggagaggggctcagccactttcctccagaatcttccctcagcccctccaactgcatatgtaatcccacaccgtatttcctccactccagctgccacttttggaagggtattgagtcaggagctgagggaaggggtgaggaaggtggacatcccatcccaactgtaatgcctttttttttgggccatttgagtcatgtatggtaccaatcaataaagagacttttcggtttgagagtgtcctggttggtcattgatgcctaataatgactcagtccaaggcaatcttttccccatccttgcagttcctaagactatgaattggat

SEQ ID NO: 12379 - DNA, 392 bp, Homo sapiens
cgaaacccgatcgctacagaaaaatgacaaaaattagctgggcatggtgatgcacacctgtagtcccagctgcttggcagaccggagcaagccaggagacctgagcaagccaggagacctgagcaagcgcaggagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcaagccaggcgaaaccccatcgctacatagatgaatgcagaatagttctatatatctggtcaacgggagacctgagcggtccaggggggatacctgtagataagaccagcag

SEQ ID NO: 12380 - DNA, 1994 bp, Homo sapiens
cgcgcacacacgcagaggccgctcgccttcctgcctggcttccttcctgtctgctccgcgcctgacaggcccctcgccgcagccaggggccgcccgcaccgggccgaggccgggccgggccggcggcgagcgcagcgggggccgcgggcggcggcggcggctcatgcccggcctgtccccgcgaggggcgggcaccgtgactcggctgggcccccagaggcgggcgatgtgaagatgtcagtgggctgtgcctgtcctggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagtta

SEQ ID NO: 12381 - DNA, 2991 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgtaagcatctcggctttcttctctcttctgggctgccccaccactcacccctgacccctttccaagcctgagctcactagcaggcgtagaagcaaagacagtttttctcatgtactctgccagcatgggctaactgcttttactggtgagagagttcttgtcaggcacttgcatgggtgtgatcacacagactcagccataggaagctagggcataaagggacagagacacccatgaggacatacggatattcaggacagacagcttggggctcacagaccatccagcacacacactcacactgatagacatgcagactggagtgtttgcagatccagaatacatacccttgcacatgcacacactgccctccctcatgtttttgatatgctccctttcttacatgtggacagaagttgaggagtcccctaaaattttggggagatgggctagggagctaggggagtagagtgacttctagaatgtaatggatatgggctaaaggctttgatgctctggtgttcttcagtaggaaggattccaggagctgagggtgtcaggagttggggttttaaattcgggtatgaggagggggtggggactcttgagcttccagggtgggtactggggctctgggggtatctgccgccctgggccgggcgagcccttgccccgattatgtttggggacctccgccactctcaggatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagtta

SEQ ID NO: 12382 - DNA, 1843 bp, Homo sapiens
  misc_feature (11)..(11): n is a, c, g, or t
cttatgttccnggcccacggactcctatggtgcttgaagtgcgctacctgccgcaaaacgtcttctctggtgacctcagttctctccatggatagttggctcagaatgtcgctcggaacgtctgtactcgtgcgaacggagtcacctgacagagtacaacgacggtttaaccctgtttcattgacgtcggcatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagtta

SEQ ID NO: 12383 - DNA, 1667 bp, Homo sapiens
aggatccttgctccacttggttgcatatgatgtgggccaactcccaatgtatccgctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagtta

SEQ ID NO: 12384 - DNA, 2192 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggaggggattctctagtacaaagcttaaattagactatagtgtcacttggctgttcttgagcgtcatgccttttagctttcattatcagccctcgtgtattctttcacatggtcctagactaactatatattacctattagctcccctctttatacccggtttgctctggacatgttttataccaacgactctgtttccacattcattatttatcct

SEQ ID NO: 12385 - DNA, 1580 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagtggcgtgaatccgggaggcggtgcttgcggtgagccgggatcgcgccactgcactccagcctaggcgacagagcaagactccgtct

SEQ ID NO: 12386 - DNA, 1604 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagccctcacccctgccaggactcctctggggttgcagtcgctcccccgtacctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccacggcccagtgg

SEQ ID NO: 12387 - DNA, 1307 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaataaagagacttttcggtttgag

SEQ ID NO: 12388 - DNA, 1740 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatttctaagcccaccagggaggaacaggcctctgtccccataggtgaggtagaggtagagggtcttcacctgccagtatcccctgccgctccttcctcacagaaggaaggaggaggaggcagccgggatcctcggctctgccagggtgcagccaggagcagggtttcacgcagctggtccagctctgtggctttgctgccttttcctgtgtccagtcccaggaagtgctaacaccacctctctccccactcttccctctggattctggggtcccccacaccgtatttcctccactccagctgccacttttggaagggtattgagtcaggagctgagggaaggggtgaggaaggtggacatcccatcccaactgtaatgcctttttttttttttttttttttttttttttttttctttttttttgggccatttgagtcatgtatggtaccaatcaataaagagacttttcggtttgagagtgtcctggttggtcattgatgcctaataatgactcagtccaaggcaatcttttccccatccttgcagttcctaagactatgaattggat

SEQ ID NO: 12389 - DNA, 1188 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtcagcaacccagctggatgtggaacaccatggcacctgggtttgattcccatcctctctcccagtgtatactcacagctgttccccagggaggcataatgtgaactggcaaaataagaagggcgggtaggcatgtt

SEQ ID NO: 12390 - DNA, 558 bp, Homo sapiens
cctattaaaagtccaactgcatatgtaatcctactctgtccttcatagaggggaaggagccacagatgacatcccagttctgccctcctagtgcttgtgactccctctcttccagccccacccccatggtatgtatattccttacaagtcctccacaagagcagctgtctaggatgcggggaggggaggctccttcccttagggagcgtggagagaagggagcagccttgttgctgtatttttggttttgtttcagttgggcaggcatgggatgggagaggggctcagccactttcctccagaatcttccctcagccctccagctgccacttttggaagggtattgagtcaggagctgagggaaggggtgaggaaggtggacatcccatcccaactgtaatgcctttttttttgggccatttgagtcatgtatggtaccaatcaataaagagacttttcggtttgagagtgtcctggttggtcattgatgcctaataatgactcagtccaaggcaatcttttccccatccttgcagttcctaagactatgaattggat

SEQ ID NO: 12391 - DNA, 134 bp, Homo sapiens
taacccttctccaggtgggatcctgcctggaaaggggagggagtagccccctgcccccaataattcctatcttcaacccccattctcatagcctcttcctttacacagcccaactcccatgtatccgcctacat

SEQ ID NO: 12392 - DNA, 339 bp, Homo sapiens
cagttgggcaggcatgggatgggagaggggctcagccactttcctccagaatcttccctcagcccctccaactgcatatgtaatcctactctgtccttcatagaggggaaggagccacagatgacatcccagttctaagcccaccagggaggaacaggcctctgtccccataggtgaggtagaggtagagggtcttcacctgccagtatcccctgccgctccttcctcacagaaggaaggaggaggaggcagccgggatcctcggctctgccagggtgcagccaggagcagggtttcacgcagctggtccagctctgtggctttgctgccttttcctgt

SEQ ID NO: 12393 - DNA, 380 bp, Homo sapiens
tgtatacctcctatgtcgttctaaggtctagaagtgggtctgggagtgccaggggatatctagattggtaggggaggcatctgcctggccccttttgcggtccctttgtcctgaagagtttgtcccatctctacagccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtcagcaacccagctggatgtggaacaccatggcacctgggtttgattcccatcctctctcccagtgtata

SEQ ID NO: 12394 - DNA, 2286 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagtta

SEQ ID NO: 12395 - DNA, 651 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggtaagtctgggcaccctgcgagcctgttgggggtgggcggaaggccctcagcccggcccgggcctgatctgcgggctgggggagaggtgccccagcccag

SEQ ID NO: 12396 - DNA, 1928 bp, Homo sapiens
cggggagcccggcgggcgccggcgcgtccccccccacccccaccccacgtgtcgtggcagcgcgcgtccgctgggggcggtgagcagcatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagtta

SEQ ID NO: 12397 - DNA, 2521 bp, Homo sapiens
caggcacgaggggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagttaaaaaaaaaatcactcatgtccccccctcttccccctattaaaagtccagctacctccctactcttggcagatgggggcctagggcctaggtgggggtgagagtgggggagggaggtgtgcataccattttatatggtgtgagagcttcagaccaaggagacatttcaccatctctccccctttcctctggggtgactgcagttgaggaaagcatgccatggggtagggggacatt

SEQ ID NO: 12398 - DNA, 530 bp, Homo sapiens
ttgagtagtttggttctatttctttgtatttgctgctgacaggtgaatgtgaccaactcaagtgcatagagcttcatgactgaagagcactcagaatgcgccgtttcaggctcatactgaaagcattctaggatgctcaccttttggtccagcgagtctgtttctaggaatttaacctaagggagtaattaagaatctacacagtgacttatttatagagatgtttatcacagcattgattgcaatattaaaaaatcagcagggcgaggtggctcacgcctgtaatcctagcactttgggaggctgaggctggtgagttgcttgagctcaggcgttcgagaccagcctgagcagcatggcaaaacctcgtctcttcagaaaatacaaaaattagccaggcattgtgtgtatgcctgtagtcccagctactcaggaggccaaggtgggaggatcacttgagcccgggaggtggaggttatagtgagctgagattgtgcagtgagcctgggtgacaaaatgagaccctgtct

SEQ ID NO: 12399 - DNA, 163 bp, Homo sapiens
tattatcaggaggaatacaccacttcataagatggagaagataccagcttctaggaacaaataatggaaattggctacatattcacatttgctctgtcaaaaatgtctaaggttatttacaagcttttgacaagctgatcaagtttcataagaagtaacgaaa

SEQ ID NO: 12400 - DNA, 383 bp, Homo sapiens
gacagatcatgaggtcaggagtttgagaccagcctgcccaacatggtgaaaccctctctctactaaaaatacaaaaattagccaggcatggtggacatgcctgtaatcccagctactcaggaggctgagacaggagaatttttcgaacccgggagatggaggttgcagtgagccaagattgcaccactgtactccagcctgggtgacagagcaagactctgtctcaaaaaaaaaaaaaaaaaaaaaaaaaaaaagaatggggctgagacagtacaagcagcttggagctctggacttggagcaaacagctatgtttaactccttatcattcaccatctgtgggcatttagcaaggcattttgcaacacttttgctttcttgta

SEQ ID NO: 12401 - DNA, 659 bp, Homo sapiens
aaaagtaagaaacaaacatggtgacagtacagttgtcccagtttaccgcctagacaaagtttccaggtgtaaggcagggagaggaaactcacgcagaatctgggagactctgagttgggcatttggagttgaaactccaggggaccacaatgacttgcaggatggagagaaggctgaacagagagagagctgttggagatctgcagaggatccgccatacgtattcaactgagcgttgggtaggaggacattagggacattgaaggccagggaaagaaccaaatgaaaagattaggaaagagaggctaacccagtgctaactcaaagctggggaagagtgcctgttctcatgagcaagagaggaaagtatcaagattcactgggcattgagtgatatacagaagggttttgcccagtagtgggggataacttgcactagatggagcatgactccaggccttcctaacaaatgtgaagagcaagacccaaaaagataaaaatgtttctaagcaacttaactgcatcccagaataaagttcaagaatatttataagaatacaaaaatatccagcatccaaaaacataaaatcacagtgtctggcattcaatcaaaaattaccaggcaatcaaagaagcctgaaaatagcaatatagttaag

SEQ ID NO: 12402 - DNA, 389 bp, Homo sapiens
taaaattactctgtcagaactatcagtaagcaaataaaggtggcttatccacacacatcttgattttgaatttacatacatttgtcataagtttggtttctattaagtataattgtttaaagaatgtctgtgtagacaaatttgaatagaattaatcatttacctataaatgtgaatttctggaaactgcaaaatgtgaccaccaatgttactttgcacatctcacctgaatagtttcaaacaagcaaaaatgtgaaactgagataagagggacttgaaccccgtaaaagaacagactaaaaatatgttgtgtcttattttaagtaaaactattaatgagaataaaataaattcgaatgtgaaggaatgtcagtatttttcttatattt

SEQ ID NO: 12403 - DNA, 259 bp, Homo sapiens
cctcccagtttttctaatctgattactttgaagcaaatcttggtatagttacttttaaataggaagcagataggcacctttccagaatctatagaacttttccttagaatggcagggcatgagtttgtcagaagccccagatggggtcttcatttcaatcaggtgttatgcttggcaacggtttccctgtggggaactttgagggacttgggaagcattgttatctgtttttgtagctgcatctgcgttaaaaaaaaaa

SEQ ID NO: 12404 - DNA, 391 bp, Homo sapiens
gcacactgaaaaacctaatgaatctggactcaattttccgccacactgctcctgagaactgtcggaaacaatgtctgtggtcggaggtgacggggtggccgccgataggccgcgaggcaccccttcccttcccaccccgggctcccggcccttcccgtcagggttagtggagagagacggacctgtctccacaacctggtgacagcccagcccgctgccacttccctaacaatgatgtcattataggtaaattggcctctatttcagcggggcggtggtgctaattgagtgagaaaatataatacagggagctgttgtctgcagctccggggagggggccgcagcctaaatggcctaccattgttgatgtcagggtaggcagatgttgcct

SEQ ID NO: 12405 - DNA, 490 bp, Homo sapiens
acttgtgacaacaaatgtatgagtttttaaattttttttatgtcaaccaatcatccaagtctctgggcaccaactgagtgttctacaattccagttcagacactgtctggggttagcccagaccccacaggctaaaaactgtctcaagattacccgcagtagaatctccagttaaatcccatgttatcacctgcagttttgaccaaccagctataaattgggggtccccttggtcacttgctagaaggtttcccagaactcaggaaagcatcgtacttactattaacagtttattataaaggatacaacccaggaggagatacacagggtgaagtgctctgggtgtgatgcctccatgctgtctcctggcacactgctctcccagcactttgatgtgttcaccagccaagatgttttctcaactctgtggttcaggagttttgatcgagctttaattacatcgacatgatagattacatcattggctatt

SEQ ID NO: 12406 - DNA, 478 bp, Homo sapiens
aactgcattatatgaagcaaattaagtcactggtttccacgtcctccagtttctgcaataatactacataaacagagaaaaaacaggatccggagacaaagacaagcctggaaataccttcaacactgttaaataggtccatttccttatgctttttctcaataactgaaatttctccatttccctccatttcccatgatgaagtttgcccagaccaattggatgatgatatcacctaggatatcaccaatactatcagctttcttcactctgtgactgtgtagttctgtaggggggttgggtagtttctctggaactaataagaagctagaattgtttgcttcatgaagagtggcatagaacactagaattactctgtgcgtggaagataaatgtcttctcccctccctttgttttattggcaacaattaagctgatttaaaaataaatccatgcttcctctgtgtggactccacac

SEQ ID NO: 12407 - DNA, 548 bp, Homo sapiens
acggagatagcatgctgtggtttacggtcagagtgttttcccaccccctgcccgcgggtccccctgcttcctgggtctacattgtaggtttgagcatgtgtccaacagcccctacctcccagaggggctgctttccagggcctgaccatgactcacacaaagaaggccttagagcccggccgctgggcctcctttggcccgggaagttgtgcgtgtctgtgctaattccaagccccgctgtgtcccgcgtcatcggtgaattcccacagagctgatctccagggcctcctcctgccctcactgcacgcagcacatgcacagcccctcctggcgggtgctgttcttttcacctgctcctcccccacccccaccctctttgcattgttcctgaagcttcaccaaatccccgactcccccgttgtacgaggacaacgagggctggggggactcagccagcccacaaagccctggattttctcaggctcccaaggaagaagagtaggaggggagtggacatacctttttttttttattttacccccttcctt

SEQ ID NO: 12408 - DNA, 335 bp, Homo sapiens
atttttctcaataaatgttgtgaacatatacgaggcatggtggaaggcatgtgtagttaacagttgcttgggaggctgaggcaggaagattgctggagcctaggagttcaaatcctgcctgggcaacacagtgagactctatcttgaagacaaataagattgtgaacatgtgtagcatactagcaggaaaagcaaaatcaaattaaagatgaataatgattcttcatcatagtctacaactaatctactagctgagttagagctatagatctacccataaatatgggaactttgtagatagctcacatcacagtgaaccattttacctagtcagt

SEQ ID NO: 12409 - DNA, 446 bp, Homo sapiens
aaatgtatccttaggcaatttcatccttctctgaacatcacagtgtactaacacaaaatagatggctcagcctactacacacttaggctattgctcctagaccacaaatctatacagcatattactgtactgaatactgtaggcaattgtaatgcaatgatatttgtgtgtctaaacatatctaaacatagaaaaggtacagtaaaaatatagtattatcttatgggactcatatatgtggtctgtcgttgactgaaaagtggcacattactgtggaaagtttctcctcagtacagttttttcttgtggaaatccatgcattcctcctaacaggagatcaatcgtaatttaaaactctgcttatctactaaagatgcagtgaatttggggcttgaattatttgcttttgttggatacttgattaaataaacacgtataatcatttc

SEQ ID NO: 12410 - DNA, 666 bp, Homo sapiens
tggtgacattttgcttatctgagtcacatttcggtaacatatcatcattttgaaagtgcggctatgacgtgctatattaaacaggaacagcctttcagtggatggggattttattaccacagtctttccatagtcatttcaaaatcaaattgttggtgggaggatggattgggttgtgagtaatctacttccatatatcagcctcagaaatggaactatcctttggatattacaggagacactgcagcagattgtttccagaagctggaaaaatatgctcccaggagaatttaatcactgggcttttgctgggggatttttagttggcgggactgtcaaggaaatgtgatgacagaaatataatccttaacacaaactggaatctggctttgaatggcatcttccattccctggattgagtcaaatgtttggccaagcagtcagttatctagctgttactgttgggatgaagaactctgttttcatcaactaccatctcacatttctctaaatacttccaagtagcccagagaaaatttagggtacaggtggctatgggccaatttctaaatagctccaattgaagacataaatctgtgttatgaaaaatgatgagttggtactgtaagattcctgatgcatttggaaattttttcaaaccaaaaa

SEQ ID NO: 12411 - DNA, 555 bp, Homo sapiens
gttgatttatttttttcaactcttagctacctccccacaataatatctattcctatgactatttaatttattgtgcaaatgcagaatactttagggagcaaaaaggagtgctggtataaattacactcaactggtaaaaactatcattgtttgcttctgttctagtcagagggttgtactctactgcagtcatacctgaaggaaggcagtagtagagcaggtgtacctgagggtggaacaacctctgcttggcctcatctaaaagtagataaagggggccgggcacggtggctcacgcctgtaatcccagcactttgggaggccgaggcaggcggatcacgaggtcaggagatcgagaccatcctggctaacacggtgaaatcccatctctactaaaaatacaaaaaattagctgggtgtggtggcagatgcctgtaatcccagctactcgggaggctgaggcaggagaatggcgtgatcctgggaggcggagcttgcagtgagccaggattgtgccaccgcactccagcctgggtgagagagtgagattccgtc

SEQ ID NO: 12412 - DNA, 359 bp, Homo sapiens
tctaatctatctatccatctatcctgtcatcattttttttcttatcacagctcccttagcctagaattcctgttgtgggtattgcatttatatttagaaaacttcaaattgtggcctgattaaatacttctaagtcccaaatgtactccaaagcagatacttaaacagtttatgcctgtagaattttttaatctcagccgaagagcagggtgactggtgtgtgtgtgtgtgtgtgtgtgtgtgtgtgtgtgtatccaagcaaaatgatgattgcctttgttctgacttgtagcgggtagaatccttcctcaattatttttctggggtgtagttgaaataaaaacttcatcattcactca

SEQ ID NO: 12413 - DNA, 738 bp, Homo sapiens
atttgttttgtcttcattctgcatgaagaactgtagggttttccctctccactctatgtaagaaaaatgataattttataatcctttatattctactttttaatttattttggtgcctggttaaaaaaagtacatacttagaaatgtggttggcatgtaagaagggtttaaaagataataaaatcgacaatttaggattgttgtaagtggtgctgaagtagaaaaaaatgaattgtgcttatctaagtacatgataactagatgtggaattagaggatgcaaattgagagatgtagaaaagttatttttttaaaaagaggcatgatttgaggatgatttttatacatggattggattaaattgttcagcaatgcttgcttattggtatcttcagtttcatatgaggataatagtagtatctaaaactcagctgtccctgaaactcttggctgggcagggagtttactaattcctgttaaaagcttgactggaaaattaataattctgaaaaacatgctatcaattcattattctaaaagcttctcctgtatttttcaagtcctgtcaaaagctggctctcatagaaagcaaggaaggtcgccaaaatgagagcaaatagaggccactcaatcagaccttgttataacaaaggtcaccgaccttcacttgtgtgactcacagaagtcacacttgtggcagagactcaaaggtagacagagaagtgggttaactttgtac

SEQ ID NO: 12414 - DNA, 409 bp, Homo sapiens
tttttcgtcatatgagtaaccttattcattttaatatcacatttcctttagtcacataagctcacgcatgcatacagtgtagcatagtgcctaatagttgctaagccctccttaagtatttagtaatggtggtggtaccaccaactaaaataacagagtaggttctcattttattcttagaaagtttttgaacttttcaacaaatagtgctagaagaactgaatagctacacatgaaagagtgaagttgggcactttctcatatcatatacaaaaattaactcaacatttatcaaagacctaaatgtaagagctaaaaactataaaactcttagaagaaaacgtgaatgtaaatctttgtaaccttggcaatgctgttttggatataacacctaaatcacaatcaacca

SEQ ID NO: 12415 - DNA, 441 bp, Homo sapiens
tttagtagagatggggtttcaccgtgttagccaggatggtcttgatctcctgaccttgtgatccacccgccttggcctcccaaagtgctgggattacaggtgtgagccactgcgcaaggctgtaactgtttattttaaaatcatgtttcttgcctttctttccctcactgtctccctccctccctcccttcctccctcccttcctcccttccttcctcgttttttagaaagagggtctagctgtgttgcccaggctggttttggacttaaggattcctcccaccctggcctcccaagtgctaggattataggcatgagcccccatgcccagccttatattgccttttttgattccgtaatggacattatctatttaaggggaaagtttttttccttccactcttctaaggtccagggcccctgtaacagaagattaataat

SEQ ID NO: 12416 - DNA, 439 bp, Homo sapiens
tataacatagtagcccttccccttgccccaggtgatcccccccaccatgtttgccatgttcaatctccaacgagccagtctccatctgaagggccatctcctgcactcctcatcagacataagctcttggacttggtccattttattctcacccgcacttctagaacctaaaacccatcgtggtacttgagaggaactcagtgagtgaatcaaagtggatcacagctcagttttggaaacaaagccaaatcacttacctagattagagctggcgtcagccatctctcctcagataatatttgaaggctcagtacagtggcgcgcacactttgggaggccaagacaggaagatcacttgagcccaggagctcaaggtggtagtgagctgtgattgtgcccctcagcctagatgacagagtgagaccctgtcacttcaaaa

SEQ ID NO: 12417 - DNA, 567 bp, Homo sapiens
agggagagggtccgaaagattcccagagaggtcccagtccggttaagggttgagaacagcagagaacttctaggtagagttgtgtagtggggggagacagatacggaatctgtgtgattgaatatatttggggaggggaggcttagggcctagccctctttcctcttaagcccccagaagacctttcctggggaagggaaggttggtgttgggcctgtcacttggctgaaatatggagtccacaccgcttctccagagtccctcagcagccctccatgtctcggggtctccacacagggaccagctgctgccccgggcttctagccagaattgcccatgccattctctcgattctttctttctctccagctgcttcatgtgagggcttgtcaggccgcgggttggaggccttagggccagaggcggtgggaccgggagaaccggtttggggcccgaacaggaccagagaactagcctgtacatccttcctccctggcacctctttcccactcctcctcactgctcctgctcggggcgcctcaaccccgacaagataggtaccgacta

SEQ ID NO: 12418 - DNA, 1489 bp, Homo sapiens
agggagagggtccgaaagattcccagagaggtcccagtccggttaagggttgagaacagcagagaacttctaggtagagttgtgtagtggggggagacagatacggaatctgtgtgattgaatatatttggggaggggaggcttagggcctagccctctttcctcttaagcccccagaagacctttcctggggaagggaaggttggtgttgggcctgtcacttggctgaaatatggagtccacaccgcttctccagagtccctcagcagccctccatgtctcggggtctccacacagggaccagctgctgccccgggcttctagccagaattgcccatgccattctctcgattctttctttctctccagctgcttcatgtgagggcttgtcaggccgcgggttggaggccttagggccagaggcggtgggaccgggagaaccggtttggggcccgaacaggaccagagaactagcctgtacatccttcctccctggcacctctttcccatcccttctgctcacctcccaacagctctgagaccctcaagtcctagtatgatcttggtgggggcggggggtggctttcccggttccatatttcactcttgccatttggaactcagagaggtcgagttctgagcaccacttggctctcaggacgtggccttatgaggtctaatcctcatccctcctgttgttttctcagccccttccctattcactgtggggttggattcgggtggctcttccgcctgggctgaccagctcaggacttcatttttcctcaacccactctcttctggctgctttaaagaagagtggccgccagtggctcttacttccttttctggctttgttcccatcccccactgccctgcgctaccatcacattcaccctgacctgtcttcttcacactctgaccccaccctcaagtttcagagaccctaatgtcctagggaatggaatttcctggtcacttctcgtcatcattggtcatttcatgccaagtcccacacacacgctttccctccacccagctctggtcaggtccctggaaaagaaacagaaatggccttgttctctccactgcccctttccctctctccttctcctccccctctcttctcttccctcccagcactatccacctctgtccctcagctttgagcagagtgggggatgttgagggagagtccagtcacagtacagcctgcctgctggtgttgggggtttcctctaattcttcatttttccccaacccttaccacctgccaccaccaccatcaggacaaaccctatgactgactcactgacgtcccactgaccacagctcccctctctggacagcgtgttttagcttccgctccttctggttactcctcccttccagtggtgagaagagaagagaaagcccagcctcctgggttctcccctcccctagaagctacatttgagtgtttgtgtgatctcatctcaaggctgttaaa

SEQ ID NO: 12419 - DNA, 1450 bp, Homo sapiens
ctagaggatcccgcaagttaagggctacccctaggtagagttgtgtagtggggggagacagatacggaatctgtgtgattgaatatatttggggaggggaggcttagggcctagccctctttcctcttaagcccccagaagacctttcctggggaagggaaggttggtgttgggcctgtcacttggctgaaatatggagtccacaccgcttctccagagtccctcagcagccctccatgtctcggggtctccacacagggaccagctgctgccccgggcttctagccagaattgcccatgccattctctcgattctttctttctctccagctgcttcatgtgagggcttgtcaggccgcgggttggaggccttagggccagaggcggtgggaccgggagaaccggtttggggcccgaacaggaccagagaactagcctgtacatccttcctccctggcacctctttcccatcccttctgctcacctcccaacagctctgagaccctcaagtcctagtatgatcttggtgggggcggggggtggctttcccggttccatatttcactcttgccatttggaactcagagaggtcgagttctgagcaccacttggctctcaggacgtggccttatgaggtctaatcctcatccctcctgttgttttctcagccccttccctattcactgtggggttggattcgggtggctcttccgcctgggctgaccagctcaggacttcatttttcctcaacccactctcttctggctgctttaaagaagagtggccgccagtggctcttacttccttttctggctttgttcccatcccccactgccctgcgctaccatcacattcaccctgacctgtcttcttcacactctgaccccaccctcaagtttcagagaccctaatgtcctagggaatggaatttcctggtcacttctcgtcatcattggtcatttcatgccaagtcccacacacacgctttccctccacccagctctggtcaggtccctggaaaagaaacagaaatggccttgttctctccactgcccctttccctctctccttctcctccccctctcttctcttccctcccagcactatccacctctgtccctcagctttgagcagagtgggggatgttgagggagagtccagtcacagtacagcctgcctgctggtgttgggggtttcctctaattcttcatttttccccaacccttaccacctgccaccaccaccatcaggacaaaccctatgactgactcactgacgtcccactgaccacagctcccctctctggacagcgtgttttagcttccgctccttctggttactcctcccttccagtggtgagaagagaagagaaagcccagcctcctgggttctcccctcccctagaagctacatttgagtgtttgtgtgatctcatctcaaggctgttaaa

SEQ ID NO: 12420 - DNA, 1360 bp, Homo sapiens
agggagagggtccgaaagattcccagagaggtcccagtccggttaagggttgagaacagcagagaacttctaggtagagttgtgtagtggggggagacagatacggaatctgtgtgattgaatatatttggggaggggaggcttagggcctagccctctttcctcttaagcccccagaagacctttcctggggaagggaaggttggtgttgggcctgtcacttggctgaaatatggagtccacaccgcttctccagagtccctcagcagccctccatgtctcggggtctccacacagggaccagctgctgccccgggcttctagccagaattgcccatgccattctctcgattctttctttctctccagctgcttcatgtgagggcttgtcaggccgcgggttggaggccttagggccagaggcggtgggaccgggagaaccggtttggggcccgaacaggaccagagaactagcctgtacatccttcctccctggcacctctttcccatcccttctgctcacctcccaacagctctgagaccctcaagtcctagtatgatcttggtgggggcggggggtggctttcccggttccatatttcactcttgccatttggaactcagagaggtcgagttctgagcaccacttggctctcaggacgtggccttatgaggtctaatcctcatccctcctgttgttttctcagccccttccctattcactgtggggttggattcgggtggctcttccgcctgggctgaccagctcaggacttcatttttcctcaacccactctcttctggctgctttaaagaagagtggccgccagtggctcttacttccttttctggctttgttcccatcccccactgccctgcgctaccatcacattcaccctgacctgtcttcttcacactctgaccccaccctcaagtttcagagaccctaatgtcctagggaatggaatttcctggtcacttctcctccccctctcttctcttccctcccagcactatccacctctgtccctcagctttgagcagagtgggggatgttgagggagagtccagtcacagtacagcctgcctgctggtgttgggggtttcctctaattcttcatttttccccaacccttaccacctgccaccaccaccatcaggacaaaccctatgactgactcactgacgtcccactgaccacagctcccctctctggacagcgtgttttagcttccgctccttctggttactcctcccttccagtggtgagaagagaagagaaagcccagcctcctgggttctcccctcccctagaagctacatttgagtgtttgtgtgatctcatctcaaggctgttaaa

SEQ ID NO: 12421 - DNA, 1067 bp, Homo sapiens
  misc_feature (93)..(93): n is a, c, g, or t
ctttaatgtgttcattgagcaactaaagaatagactcagatataggaaagtatttatttatttatttatttagagacagggtctggctctgtngtccagatcataactcactgtaacctcgaactcctgacctcaggtgagcgtcctgccttggcctcccaaagtgctgggattacaggcgtgagccactacacccagccaatcagttgcttttaaactacttaaataaaaagagccaacccaaaatcttgtgcatgcttgggaaactggcagtggaatatgagaagtctttatttgtggtgcacacaggtgactcgggctgttgtgtattggttcttgcctcgatctgtagcaagcaatctgttgtttcttgcctgccttttgggaagaaatgaaaaaagaagcagcacgagtctccatacatcatgattgtgatggcactgggcctgagaccttttctgctgtccaggtaaaaatgtgaagaccatggttttgaggtttcttaataaattcaggtgttaagtgccaagtgatgctcccagcccctgagctagagcaactatgctgttcatgtccccaggaatggaagtggaccctagttaggtgctggtggccagccatgtgtacctagggcagggccaggtcgtgtgtgtgtgtgtgtgtgtgtgtgtgtgtgtgtgtgtgtgtgagagagagagagagagagagacagagagagagatagagagaaacataaaggtgatcggcactcagacatcctgtgtggtccacctcacttctcaagcaggtgtctttccagtctacaactcgttgaccacaggtggaattcataagctctgttccctgtcctgcttgggtcctccagagaaagaaatgttgaattatcatcttggtgatggtcaactctgaaagcctaaattttcatgatcaccaaagtgtttggatttaaaagggtggctcactccgtaattccggcactttgggaggctgaggcagaaggatcacttgagcccagaagtttcagactaggctgggcaacaaagcaagacccggtctctaccaaaaaa

SEQ ID NO: 12422 - DNA, 1048 bp, Homo sapiens
  misc_feature (93)..(93): n is a, c, g, or t
ctttaatgtgttcattgagcaactaaagaatagactcagatataggaaagtatttatttatttatttatttagagacagggtctggctctgtngtccagatcataactcactgtaacctcgaactcctgacctcaggtgagcgtcctgccttggcctcccaaagtgctgggattacaggcgtgagccactacacccagccaatcagttgcttttaaactacttaaataaaaagagccaacccaaaatcttgtgcatgcttgggaaactggcagtggaatatgagaagtctttatttgtggtgcacacaggtgactcgggctgttgtgtattggttcttgcctcgatctgtagcaagcaatctgttgtttcttgcctgccttttgggaagaaatgaaaaaagaagcagcacgagtctccatacatcatgattgtgatggcactgggcctgagaccttttctgctgtccaggtaaaaatgtgaagaccatggttttgaggtttcttaataaattcaggtgttaagtgccaagtgatgctcccagcccctgagctagagcaactatgctgttcatgtccccaggaatggaagtggaccctagttaggtgctggtggccagccatgtgtacctagggcagggccaggtcgtgtgtgtgtgtgtgtgtgtgtgtgtgtgtgtgtgtgtgtgtgagagagagagagagagagagacagagagagagatagagagaaacataaaggtgatcggcactcagacatcctgtgtggtccacctcacttctcaagcaggtgtctttccagtctacaactcgttgaccacaggtggaattcataagctctgttccctgtcctgcttgggtcctccagagaaagaaatgttgaattatcatcttggtgatggtcaactctgaaagcctaaattttcatgatcaccaaagtgtttggatttaaaagggtggctcactccgtaattccggcactttgggaggctgaggcagaagtttcagactaggctgggcaacaaagcaagacccggtctctaccaaaaaa

SEQ ID NO: 12423 - DNA, 300 bp, Homo sapiens
agcctcctgagtagctgggattacaggcgtgtgccaccgcctccagctaatttttgtatttttagtagagaccgggcttcaccatgttggccaggctggtctcgaactcctgacctcaggtgagcgtcctgccttggcctcccaaagtgctgggattacaggcgtgagccactacacccagccaatcagttgcttttaaactacttaaataaaaagagccaacccaaaatcttgtgcatgcttgggaaactggcagtggaatatgagaagtctttatttgtggtgcacacaggtgactcg

SEQ ID NO: 12424 - DNA, 243 bp, Homo sapiens
gctatgactgcattacctgaaggacctcatctggtcgacacaagcccatgtggtcagcatttatccacccccacttacagagggggtcaccaccacttatagaagcttacagggtaagtcactcactcatgctcacaaaatgtgtcaagggcagaatccaagcctccacacctcccaaacccaggctctgagccactctgctgctgagaggccattgggtagagtgggtaaatatgcacagcc

SEQ ID NO: 12425 - DNA, 430 bp, Homo sapiens
gctaacacgacaactcacccacattcctgagtaaacaccaagtaaagagggagaggcaggtcacgtgggtagagagtggatgagggggattaaaagcatttcctggacaatccacattcgtataatccagtgttgagcactgtagccctccagctcccatttaggaggtactaagctagtgctgatggcattccacaaagaccacccatatgatgcgcacctgcagcagttggccggagccgtgggcagagcacccctgagaacacactcagcccctcacacccaactcaaggcaccttaactatgagcaaaagactgtttactgtttgttgcatttgttcagtttgtgaacagattctagattgaagctctgcctcaagaagacaggagagaaggccacacaccccataggagaagcatgctagctcgg

SEQ ID NO: 12426 - DNA, 689 bp, Homo sapiens
aaaatacaaaattagtcgggtgtgctggtgggtgcctgtaatctcagctactctgtaggctgaggcaggaaaatcgcttgaacctgggaggcagaggttgtggtgagccaggatcacaccactggactccagcctgggcaagaagagcgaatatttcgtctaaaaaaaaaaaacctgacccaattgtttggagtgtctgttgccaactcccctgagctagtgacctagtgggagcggccggaaaggctgttgccttttggaacttcagcagcccgacagacgactccatcactggccaggtgcctcctcccaaggtgggagacgaatgaggcagtttgtaaaggcttctgaagagtgttagagaaaggtgctgtgcaaatacaggtattgttatttacaagtgatggatggcactgcatcatgtcctggcaaatgtgctgtcgtctgcagtcctctgtagaagtaatccagccttaatgatttgagaccttaccactgctcttgactacaaaatatttgcagagaaatggggtgagactgcttgtttgatgagttattgcaaatgcagattagcagagttagaattagcgagattctttctgtttcatctaacagcagtcatagcattccacagcagaaaagaggacctaattataagcctcgctattactcatttctgccagtctttg

SEQ ID NO: 12427 - DNA, 2094 bp, Homo sapiens
tgagttggttccggctttattttgttattttgctcttttcgtcagttttttcctaatgcttccgtcctgcctgttgtgctagtgaattagtaactttcttgaatctgcgttctttcttcctctgaatatgcaaggtattagctctacttctgttatactactgggtactatatgtatgtactatgtacatttgtagaaatccaaagttggctcggcttcccaaagtgtgagtcactgcacccagccttgctgaattttcttaaaacttttttttttctgacatcttgagttaaaagtcttttgttattctttgagacgggatctggctctctcacccaacctggagtgcaatggtgcaatcacagctccctgtaccctctgcctcctgggctcctgcccaagcctccagagtagcagacactgttggcagatcacaccagttaacttttttaattttttgtagagatggatggagtcttgctgtgttgcctaggccggtctgaactcctgggctgaagcagtccacctgcctcagtctcccaaagtgccaggattccaggcgtgagcccacgtgcccgccaagtctttgtaagcgcatttccggctgtgtttcctgtgtgctcctggctgctccctgcggactttgatgaataatattttcactggcattcatttctaaagaagctgtaatttcatcagagttcctttttaatcgagaagtttgttctgaaacatttgagtaacgtggcctttttgggttccatccactcctctttctagtctccttcccgggcggtcagggagtgttgtctacacggatctctgccttgggggattgagatcttcttgcttgttcacttgggtgcagattttccaggggtcctggggtgattttcctttggctgagtttgctggttggtgtggtgggtaaacaagcggaccccgggggccagttgcccacgtcctgctctgcctttagccagggtgtggcccttcacaagtgacctacctctgcctcagtttctctgtctgtggcgtgaggtggtggtgagattgcctcgaggtttttatgaagattaaatgatttcctatttgtgaggcactttgaggtgttaagttgaatgaatgagaaacaagcaggcagcctgggagattgtgaactccgacatccaagtccggtcgtttttcttgtggattcttgttttctccgtgtctctgtaacctcgcggtgttgcttaggagccgtgctgctggctatgcaggctgatggttcttacgtagttttgatgacttgcaccttttgccagtgtggattctttttttttcttttttcctgttcagtgtgttttcgctctaacccccgattctcttgtactaacatcgctacagttgctgttggtctctgcttccaccctccctgtcatttgtttcagctgtgttacggaggcctttgctttgcttttttgcacacatctcaggttctctttgataggagagtttaacccgttgtctttgttgtgagaatacattttttcccctctccatgagggcttggatccggttttggtgtcttctttctctgctctaatggtttgggaattttgcattctctttctgttcttcttgtggctgcccttaaacttggattccgtgtccgtttgtgggattatccgcgtctataacttcgtgatgagttcctgatctccgtcttccaaaacttgggaagtcatccgagggtttgttccagattgttttgggtaattttaaaattttatttcacactaattttattctaggaatcgcttcttcatcttactgaagttttgatgcgacgttatagttatttaggcttaacgggaggttgcatgggttttgtggccgtttctggtgtcttcctggtgtgtttggatttgtgcttcgccacgtccgcacgtcacttctgagcccagtgcggtggcccctgagctcctgccggtcacgggctgtgtgttgtccccctcacaccagagacagtcgtttcttctcttaactcttaagccctcctcagtcactcggatgaactgattaaattctgtgcttttaatactaagcatt

SEQ ID NO: 12428 - DNA, 2364 bp, Homo sapiens
tgagttggttccggctttattttgttattttgctcttttcgtcagttttttcctaatgcttccgtcctgcctgttgtgctagtgaattagtaactttcttgaatctgcgttctttcttcctctgaatatgcaaggtattagctctacttctgttatactactgggtactatatgtatgtactatgtacatttgtagaaatccaaagttggctcggcttcccaaagtgtgagtcactgcacccagccttgctgaattttcttaaaacttttttttttctgacatcttgagttaaaagtcttttgttattctttgagacgggatctggctctctcacccaacctggagtgcaatggtgcaatcacagctccctgtaccctctgcctcctgggctcctgcccaagcctccagagtagcagacactgttggcagatcacaccagttaacttttttaattttttgtagagatggatggagtcttgctgtgttgcctaggccggtctgaactcctgggctgaagcagtccacctgcctcagtctcccaaagtgccaggattccaggcgtgagcccacgtgcccgccaagtctttgtaagcgcatttccggctgtgtttcctgtgtgctcctggctgctccctgcggactttgatgaataatattttcactggcattcatttctaaagaagctgtaatttcatcagagttcctttttaatcgagaagtttgttctgaaacatttgagtaacgtggcctttttgggttccatccactcctctttctagtctccttcccgggcggtcagggagtgttgtctacacggatctctgccttgggggattgagatcttcttgcttgttcacttgggtgcagattttccaggggtcctggggtgattttcctttggctgagtttgctggttggtgtggtgggtaaacaagcggaccccgggggccagttgcccacgtcctgctctgcctttagccagggtgtggcccttcacaagtgacctacctctgcctcagtttctctgtctgtggcgtgaggtggtggtgagattgcctcgaggtttttatgaagattaaatgatttcctatttgtgaggcactttgaggtgttaagttgaatgaatgagaaacaagcaggcagcctgggagattgtgaactccgacatccaagtccggtcgtttttcttgtggattcttgttttctccgtgtctctgtaacctcgcggtgttgcttaggagccgtgctgctggctatgcaggctgatggttcttacgtagttttgatgacttgcaccttttgccagtgtggattctttttttttcttttttcctgttcagtgtgttttcgctctaacccccgattctcttgtactaacatcgctacagttgctgttggtctctgcttccaccctccctgtcatttgtttcagctgtgttacggaggcctttgctttgcttttttgcacacatctcaggttctctttgataggagagtttaacccgttgtctttgttgtgagaatacattttttcccctctccatgagggcttggatccggttttggtgtcttctttctctgctctaatggtttgggaattttgcattctctttctgttcttcttgtggctgcccttaaacttggattccgtgtccgtttgtgggattatccgcgtctataacttcgtgatgagttcctgatctccgtcttccaaaacttgggaagtcatccgagggtttgttccagattgttttgggtaattttaaaattttatttcacactaattttattctaggaatcgcttcttcatcttactgaagttttgatgcgacgttatagttatttaggcttaacgggaggttgcatgggttttgtggccgtttctggtgtcttcctggtgtgtttggatttgtgcttcgccacgtccgcacgtcacttctgagcccagtgcggtggcccctgagctcctgccggtcacgggctgtgtgttgtccccctcacaccagagacagtcgtttcttctcttaactcttaagccctcctcagtcactcggatgaactgattaaattctgtgcttttaatactaagcattaaaaaaaaaaaaacatatgagggaagcacctgccacccaggcccatgtttctgctctcagccttgtgccctcccccggtggcccctccaaagggcatgaagctgtggatgctgtgcctgtgcctggaggctctggccctcccacccctggctgggctccagctctaggtttgttcagcagccaactcagagcagccgaggctcagggtggcatcagccggccgcgctggcttcacagccgacctcttctccatcatctgacgggcgcagg

SEQ ID NO: 12429 - DNA, 443 bp, Homo sapiens
tatcctgcttccttcaaacctcccatcttttccaaacttaggatctccaggtctctcagtgagtccctctgtgccttggtttctagaatctgttcttaacaaatggttagagaaaataaaaataaatgttccaggtgagaacacacacacaaacttgagccaaagccggaagatgagagggcatgcagtgcagatacttaaggagggaatcccagagagggaggagcatgtgcaaaggccctgaggtgggggtgtgctgggattttcatgggagagcagaaaggaccctgtggctggagtggggagggtggggtgaacagcagatgtagggaggacgcagactctggatcttacccccggggacatggggaagccagtggggtttgggccacagaaacttccgaatcttgtgttttgaagggagcactcagccactggctgct

SEQ ID NO: 12430 - DNA, 523 bp, Homo sapiens
aagaaaatttcaacattttactttttatacatatagaacattactaagctcagcccatttaaaaatctataaagcagttaacccagaaaacaaaacttataaaacatattaataaaagtgaaaacatacaaattagtatctctgtaaaatagtaacagctgtttttgtttgtttgtttttgagacagtctcactctatcacaggtcactgtaacctctgcctcctgggctcaagtgatcctcccacctcaccttccctaatagctgggactacaggcatgtgccaccgtgtccggccaatttctgtattttttatagggacgaggttttgccacgttgcccaggttggtcttgaactccaggctcaaacaatctgcctgcctgggtctctcaaagtgctgggatgagccactgcacccagccccattaaaagtttcaaatacctacaggtcacatatcttggcaatatactatttagccaccaatccacatatataacgtactctcatcatgctccaaaaagg

SEQ ID NO: 12431 - DNA, 500 bp, Homo sapiens
gcgatccccacgcctcatccagtggactgaattctctgtttgtctgttgtggaaataaaaccttctggggatgaatcaaaactatctgacaattacttgaaatgggtgaatagctaaatgtaatgtgccttggatattataactaaaaggtgctataatccagttatattttttatcttttaaggattggttctgaggagcactaccagtaaatattgcaaaaattacataaagctccaaaagctactctgtgtaaacttcttgagtgggaattctcaaccataatatctggaatatgactgataattctggatgttaactgattttatgttctgatgttttgactggttttgggaaaaattttgggaaaaaagagttttcctcgtaaatacccaacaactgggtctctgggtaaaaaggcctaatttatagagattgctaatttccatggtgtaaatatttccacaatgcagattccttccttcctttttttttttttt

SEQ ID NO: 12432 - DNA, 2961 bp, Homo sapiens
ccagagcatattctactgcttcacttttaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12433 - DNA, 3387 bp, Homo sapiens
ccagagcatattctactgcttcacttttaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatgaatcaaaactatctgacaattacttgaaatgggtgaatagctaaatgtaatgtgccttggatattataactaaaaggtgctataatccagttatattttttatcttttaaggattggttctgaggagcactaccagtaaatattgcaaaaattacataaagctccaaaagctactctgtgtaaacttcttgagtgggaattctcaaccataatatctggaatatgactgataattctggatgttaactgattttatgttctgatgttttgactggttttgggaaaaattttgggaaaaaagagttttcctcgtaaatacccaacaactgggtctctgggtaaaaaggcctaatttatagagattgctaatttccatggtgtaaatatttccacaatgcagattccttccttcctttttttttttttt

SEQ ID NO: 12434 - DNA, 3042 bp, Homo sapiens
atcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12435 - DNA, 2907 bp, Homo sapiens
ccagagcatattctactgcttcacttttaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12436 - DNA, 2902 bp, Homo sapiens
ccagagcatattctactgcttcacttttaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12437 - DNA, 2662 bp, Homo sapiens
atcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12438 - DNA, 1196 bp, Homo sapiens
  misc_feature (1149)..(1149): n is a, c, g, or t
ccagagcatattctactgcttcacttttaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaaggtnttttgggccaaaggattttgggggaaaaatttttccattaaggttac

SEQ ID NO: 12439 - DNA, 2797 bp, Homo sapiens
cgctccgcaccccactcttccccctagtcggctccgggttaggctccgacaccggaaggcactccagggagactggaaggtgggtgggggagcagggccttcctacctgtttccagctcctgccagcgtcgcttaagcagcagaggagagccctggctcccgcctccagcttcttttggccctctcagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12440 - DNA, 2732 bp, Homo sapiens
atcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggcaacagtttactaccatcaagttcagtgctttgactttgatcaactgactgggtttatccaaagtacagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12441 - DNA, 2532 bp, Homo sapiens
atttcctttgtgtttttctatgtttcaaaattatctacaatgattaaccagaaaagcaataattatcatacataaaatagaactcttaaagaatatctttcctaggctcgggccaagaaaaaaatatcatattatttttggccagagactaccagaattaagaaattaaagagaaggattttgcagaataacctcaaaggtagtctcaaaatccacaattatactaactgaacacagagaaagagagagagtatacatcacctacctatgtcatgtgtttttctttttctctttgtaaaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatccatgagaaattaccaaaatgtccaccaatagaatgagtgaatcaccctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataattcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12442 - DNA, 924 bp, Homo sapiens
atcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaaggttagtagttgcttcctgtgtttactaacaccgggctgtctccatggccctcttcagccttattacccaacctgtgtaatcagctccctccattaaatcccctctgtttga

SEQ ID NO: 12443 - DNA, 993 bp, Homo sapiens
atcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggtgagcagggctatctctgtgtgttgtactccagtcagggggttccagcagcacccgcaggctctagagctcaatgcacagttctttttgtttcacctgcagtcctttcttctccaggatatgcacaggcctccagggtctttcatggctcagggtcagggtggctcaagtgccaacccacatgttgtcctccaaatattcccttctatccctggcatgctgttgctgagctcaacttttaatttttgactttctcctttgtaattaatctctatctgggtttctctctttctctgtgccatttggtttccttaattagttccctgtgccagccca

SEQ ID NO: 12444 - DNA, 584 bp, Homo sapiens
  misc_feature (2)..(2): n is a, c, g, or t
tngctagacctagtggatttcccgggctgcacgaattctttacgacctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatga

SEQ ID NO: 12445 - DNA, 409 bp, Homo sapiens
tgtagagacacggttctgccatgttgaccaggctggtcttgaacgcctggcctcaagtgatccacctgacttggccttccaaagtgctggaattacaggtgtgagccacggtgcctggctgaaggtaataatttctaaaccctaagagaaaggggtgagtttgggtagggaagaagcactttagacattgggaaaaaatctgaatacagtcatgtatgcaaaaacaatgaaaataactttacttttagaagggagacagtagaaccagtgtcgtcgcgttcgggattttagctttcgcatccgttgattttggtacctgggcttttaggtggtttcccgtttatccttccctcagttatcatatctggctaggactatatttttgagcttgggggggcccagtggtgtg

SEQ ID NO: 12446 - DNA, 483 bp, Homo sapiens
gaccagcacatccccacggaggatccagattggaggagaggagaggagagaagtggagagcagagagaagttgggctcttgacctctttcctgtgtctgctgaaagggagagttaagagacatgtaatagtggatgacatcatgggcaagtgcctgaggccttcctgtgcagcacaaagcctgtataatcctgtagtttggggagaggaagttgagagacctacttacacattctaaacatcttaaatgaagtcgctcatagctttgttcttctcaaatgtggaacttattttacatctggggtcactgtgagttctaggcaatgtgaagctataactcagagccataaatttattcatataaatgaagaaccaaattcaaggggaaaatatctctcattgtatatattatctgtaacaagcaaaacaaatttatagcattttttctaacctctgggggcagaaaattctcaaaagtttccag

SEQ ID NO: 12447 - DNA, 233 bp, Homo sapiens
tttttggatagagagaggactcactatgttgcccaggctggtctcaaactcctgggctcaagatatccccctaccttaccctcccaaagtgccgggattataggcatgagccgctgtgcccagcctaaagtcaaatatttcattaaattttacaaatcttggagactttgaatattccaagtgaagtttaccaaacagggatacctttaatttttttttagcacagattatct

SEQ ID NO: 12448 - DNA, 389 bp, Homo sapiens
attatgtcttctgtaacttggctcacttaatagctattgaattgcactggtacaggatggatgaggactcataacttctttgccaaggcaaatgctgaactaggttgttctcaggatgtaactaattaatttgacttagggattttaaaaaagtgttttgtctgttttagctgtttcatttagtttgctcttacacattaagatttctactcagtactctagtatcctgaattatttggattaaaggtgcttatatgaacgtcagtaattaggaaaaaaaccttttatgtccagtgtaatggaattaggaaatttgagctactcttaaatgtatctccttaaatcgccttatttaatacaaccctgaactattaaatgtatctttactg

SEQ ID NO: 12449 - DNA, 177 bp, Homo sapiens
aaagttctaaagagagaaaaaaagcacttccattgatcccctgcccccctggattagtcccatccatgggaagttatctatatcttatacatttatgtacatatcttccatttttgaaagataggtttataaaataataaaaatttcagaaataaatagcatgtagataggtaacat

SEQ ID NO: 12450 - DNA, 520 bp, Homo sapiens
tatatatcttaatcatgagacgaggcagcactatgcacattgtgcataatatgtgagacattgaatggtataaaataaattttaacttttatctaaggtttacaggaaaagcagcaatacctatgattaagccacccgacttaaatgagtgtttttaagatgtggtgcttgcacataagcggaggagtggtggtaacaacccttgtacagttcacaaatccaggactggcaggaaggtagacaagtgtcattctcagatttcagaacccagcctgaaagtgagaggacgtcaggcaacaataccatgcaacgacagcgtgcaacaaatacacaactggattatctttttaagggagaagcttgtttgggtttctaattgcttttaatgaaccaagtattgattactgttttacccaaaactgtaccaaaatatgtgtaaaactgataagataatttatagctttctagttatggaaaagcttgcaaattaaataattcaaatctcaatttaagaactgta

SEQ ID NO: 12451 - DNA, 293 bp, Homo sapiens
ggcaatttgatgttgtgacatccaggtggcattttactttcctagtttgtttttattctacagaaatattgatttacggtggattggatgggagaagatccatcaccacattgtttgagaagcctggctctagaaaaatgtaccctcagatgttaccagttgttgctagctgctgaggatgctggtgatttttagttttcatttcttggtgttttctgaaatatttacaatgaccatctgttataattttcatgggatgggggtggggaatgaagtctgttgtaaaaaaaaaa

SEQ ID NO: 12452 - DNA, 480 bp, Homo sapiens
ggctggatgattctttgttgcggggtggggatggaggcattgtcctgtgcattgtaagatgcttaacagtgtccctggcctctacttactagaccccagtagtaccacgactcctcccctctagttgtgacaactaaaaatgtctcttgatattgccaaatgttccctagttgaaatctactggcctaaagaatctaattgttgggcacatttgaaaggtatggggttgtttattgttgttgttttgtttttgagacagagtctcactctgtggcccaggctggagtgcggtgtggcaggatcatggcttactgcagcctcgacctccccggtccaagcaatcctcccacctcatcctcctgagtagctgggagctatggaaggggaattgcttgaacccgggaggcggagattgcagtgagccaagatggcgccaccgcactccagcctggcgaccagagcgagactctccaaaaaaaa

SEQ ID NO: 12453 - DNA, 367 bp, Homo sapiens
ggtggtgtcttactctgtcacccagcctggagtgcagtggtatgatcttggctcactgcaacctccatctcagggttccaatgattctcctgcctcagcctcctgagtaactgggattacaggtgcctgtcaccattgctggctaatttttgtatttttaatagagatggggttttgccatgttggcctggctagtctcgaacacctgacctcaggtgatccgcctgcctcagcctcccaaagtgctgggattacaggcgtgagccaccatgcccagcctcttttttcttttctttgagacaggtcctcacattgtcacccaggctgcaaggtggagtgcagtggcacaatgatggctcactgtaga

SEQ ID NO: 12454 - DNA, 1661 bp, Homo sapiens
agattgcacaggaggaggcggtagcggaacctttctcctccgcctggttctcgcttccacccgggcccagttggggacggacgcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtatgaacgactttcgaagtaaaatgcaatcaatatttccaacaattcccaagaactccgaatcggctgttgagtgggaggaaacattgaaatccaaatgagatgagcatggatgaatttcaaaatgcttgttacagaaaggggtggctctggagacaccatgacagcaaaaggactgggactgatttctcccaggaacatgggcagattgctgactgaaccagtgcactggatagcattcagcctcatcacaggagagtatgtgtgtgcgtgctgggggagggtaaagttttcccacagttaagaagactatttaaaaatagtaattacaggaataacttccttatgtggaggggaccccataggaaatgattctgtttgtaacagttgaagcaaatttcatactaaaaaagtttataataaaagtatgataagaaaatatttataaaacagaccccctaatagcaatagtactgcaatgtgtctaattaaaggagtttcaagagcctttcttgtcaatatatgacagaacttggaagtcttattctgattagccagactacaaagtgacagtcacctggtaagtcctgtatggtaggaagtgggtgtggctctcgggtcctaaatgtggtctgtgctttacagccatcacacacatgctagttatttacctgatgcccttgcttgaaggccctataaattcttatacttaaaacaaaaagccagtaatgagttgtgatcaccccaaaaggcacagttgggctaaaataatgatatcaggggtaaacatatttttttgagaagttggtctggatctctgaacactgacaatttgtcattttgtctcagttgtcaaagtaaaaaaagcccagttgtcatccgtcttcaatatttttaaccagaaagtcacctgagtacggagtcccaatataaagtatttgggaccacctccctaacaaagctgttagggtaaattctgtgtgcacgcccaactccctcctgtcttccacagtctcctacaaaaaaaacagatggagaataatgtctacatgcaattgtttttactgcaattgtattttaaaatattttcaagaagagaaatactttaatatgtcaatatgtccagagaaaaaacctgtagttaaatatcagttgtgcaatttcttcctacttgcctaggctctaattagtcagcaatcaggtttaataaaggacatttgaaatttcaaaaaaa

SEQ ID NO: 12455 - DNA, 1552 bp, Homo sapiens
ggcacgagcattcgtggaccccggagcctccagcccagaggccggctgcccagttgcagcgcccgctgtctccatgtttaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtatgaacgactttcgaagtaaaatgcaatcaatatttccaacaattcccaagaactccgaatcggctgttgagtgggaggaaacattgaaatccaaatgagatgagcatggatgaatttcaaaatgcttgttacagaaaggggtggctctggagacaccatgacagcaaaaggactgggactgatttctcccaggaacatgggcagattgctgactgaaccagtgcactggatagcattcagcctcatcacaggagagtatgtgtgtgcgtgctgggggagggtaaagttttcccacagttaagaagactatttaaaaatagtaattacaggaataacttccttatgtggaggggaccccataggaaatgattctgtttgtaacagttgaagcaaatttcatactaaaaaagtttataataaaagtatgataagaaaatatttataaaacagaccccctaatagcaatagtactgcaatgtgtctaattaaaggagtttcaagagcctttcttgtcaatatatgacagaacttggaagtcttattctgattagccagactacaaagtgacagtcacctggtaagtcctgtatggtaggaagtgggtgtggctctcgggtcctaaatgtggtctgtgctttacagccatcacacacatgctagttatttacctgatgcccttgcttgaaggccctataaattcttatacttaaaacaaaaagccagtaatgagttgtgatcaccccaaaaggcacagttgggctaaaataatgatatcaggggtaaacatatttttttgagaagttggtctggatctctgaacactgacaatttgtcattttgtctcagttgtcaaagtaaaaaaagcccagttgtcatccgtcttcaatatttttaaccagaaagtcacctgagtacggagtcccaatataaagtatttgggaccacctccctaacaaagctgttagggtaaattctgtgtgcacgcccaactccctcctgtcttccacagtctcctacaaaaaaaacagatggagaataatgtctacatgcaattgtttttactgcaattgtattttaaaatattttcaagaagagaaatactttaatatgtcaatatgtccagagaaaaaacctgtagttaaatatcagttgtgcaatttcttcctacttgcctaggctctaattagtcagcaatcaggtttaataaaggacatttgaaatttcaaaaaaa

SEQ ID NO: 12456 - DNA, 822 bp, Homo sapiens
agattgcacaggaggaggcggtagcggaacctttctcctccgcctggttctcgcttccacccgggcccagttggggacggacgcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatctttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggcaagaaactggtggactgtatctctcacgtctgaagcagtaatcctctatccacatagccatcatctgctgt

SEQ ID NO: 12457 - DNA, 1891 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattgga

SEQ ID NO: 12458 - DNA, 466 bp, Homo sapiens
agatgctgctgaagtttctctaagaagggaacggaggcacctgccatagtgatggactgaggtatggtagtgagtactgagtgctgagtgctgatactgagcacagagtactgagtattgagcaccgagtactgagcatgggccagctgggttttgggcccatttcaccttccccctggcctctggggtgcccctaactgggatccctgccatgcacatgacagattccccctgcggcctgactgtggctccaggtttccagagagggtccccaacccggcaggacccctgttcaggtcctaagtcatttgtcggccatgttctgtccccagaaccgcggcaaggggggtgccgtgagcaagctgatggagagcatggcagccgaggaggactttgaacccaaccaagactcgagcttctctgaggacgagcacctgccgcgtggcggggctgtggagcggccgct

SEQ ID NO: 12459 - DNA, 886 bp, Homo sapiens
ctcaccccccaggatagagtacagtacacttggtggggtgggcggggggtgtgctggggactgggaggccggtgaagccggtgctagacactataatctaacaggatagagaagtgtttgttagggagagaagagggagaggcaggagccggcccaagcccaggtccctgcttgggccccagaaagcacttaaccaggccccaagccttcaagggaaaccaaggcctcaaccagacaatcttgagggaaggaaaagccagactttgggtttgttttttgggggaattattggttttttttttatgtttcttttggaattttgtttgttggcaaattctgtgtgatcttttttcataaaaaaaaagaaaagatttaatggggacaacacattaacaacaaaagacaaaaaaaaaaaaaaacaaaaaaaaacccaaaaccaaaaacgcttgcaggaagagagagaaggggtgttttgttcctcctgggagggcgcacttagggtggcacagaacttgggggtgagtgagtgagggggacaggggtgctgcctgtgctttccctgccgtttgatggctcctctctgctgcttcctcctccagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgct

SEQ ID NO: 12460 - DNA, 429 bp, Homo sapiens
ctttagagacaaggtctcgctctgttgcccaggccagaggactgtggcaccatcaccactaaaagcctttacctcctgggctcacgttatcctcctacctcagcctccccaaatagctggatcttcagacacatgtcactgcacctggctaatttattgtttgtagagaggggatctcgctatgttgcccaggctgatcttgaactcctgacctttagtgattcttctgccccaacctcccaaaatgctgagattacaggcatgagccaccatgcttgaccacccgtatcttacagaggtccttactctcttttctcctgtctcagaagacgactttaaaagtgaataagatacctgggaccccaaaggaagacagtgatagtgaccatagttatcaaagtattgaaaagacccttctgtgatatggta

SEQ ID NO: 12461 - DNA, 342 bp, Homo sapiens
agtcgtgctagaacaaccacagaaacagcttaatggcaatgccggcttgcctcactgggagggtgctaggggaagaattacacatcctcttcatgccactgacatgctctttatactacaacagccgggccaggcatggtggctcatgcctgtaatcccagcactttgggaggccgaggtgggcagatcacctgaggtcaggagttcaagaccagcctggtcaacatggtgaaactccgtttctactaaaaataaaaaaattagctgggtgtgttggggggcacctaccacacattaacagtgtctgttcttgggatgctgagatgtggggtgattttcctt

SEQ ID NO: 12462 - DNA, 314 bp, Homo sapiens
cccatccccaaggactctgacaaagcaaaagaaaaagcaagtgccagagaaagtaactgcataccaaaagtcaggtttacattataaagtccctcaactggctgggcacagtggctcatgcctgtaatcccagcactttgggaggccgaggtgggcagatcacctgaggtcaggagttcaagaccagcctggtcaacatggtgaaactccgtttctactaaaaataaaaaaattagctgggtgtgttggggggcacctaccacacattaacagtgtctgttcttgggatgctgagatgtggggtgattttcctt

SEQ ID NO: 12463 - DNA, 7182 bp, Homo sapiens
  misc_feature (5629)..(5629): n is a, c, g, or t
  misc_feature (6098)..(6098): n is a, c, g, or t
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgangtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaaaatcacagggacccggcgggtggaggttgcagtgagttgagatcgcaccactgcactctggcctgggggtgacagagattgtctcaaaaaaaaaaaaaaaaaaaaaaaaagaaattgaacaaatttacatgagaaaaaattaaaagttaagttggatgggcacggtggctcacgcctgtaatcccagcactttgggaggccaaggnaggcggatcacttgaggtcaggagttcaagaccagcctggccaatatggtgaaaccccatctctactaaaaatacaaaaaaattagccgggtgtggtggagcgtgcctgtaatcccagctacttgggaggctgaggcaggagaatcgcttgaacccacggcaaaggttacagtgagctgagatcgtgccactgccctccagctggggtgacataacgagattccatctcaaaaaaccagtgccaggcatggtggctcatgcctgtaatcccagcactttgggaggctgaggcaggtggatcacctgaggtcgggagttcaagaccagcctgaccaacatggagaaacctcgtctctactaaaagcacaaaattagccgggcatggtggcacatgcctgtaatcccagctactcgggaggctgaggcaggagaatcgcttgaacccggcaggcagaggttgcagtgagctgaaatcgagccattgcactccagcctgggcaacaaaagcgaaactcctccaaaaaaaaaaaaaaaaaaagcaaagctgcacatttccagccatgcctaccacaaaatgatactagaagaaaatgatactaatgctaagagtggccccaagccctcacctagatgggggtggacggcatctctgcactggggcctagggaagctataggtgggggtctggctgcccagtgactgacctggttagtgtgggtggcctgcagaggacattcggggctttgcaaagagggtaacccatggagggcagccagccggcctcgggcaagggaagggcccggcatgggctctgggaaacactctggtgtcacctggcgcagtcttggcccaagtggccgcccacctgggccccagggaggatgcctgccagagcataggtggccctcgtgccctcctttacgggacccacatcaaaacctggaccagccccattccttggggaagctaaggacagaacaggccgggcctcaagtgttccccctgccttggcctcccaaagtgccaggattacaggtatgagtcactgcgcccggcctgttctgtccttggggaagctaaggac

SEQ ID NO: 12464 - DNA, 6311 bp, Homo sapiens
  misc_feature (4758)..(4758): n is a, c, g, or t
  misc_feature (5227)..(5227): n is a, c, g, or t
acaattttatcattattttaatcaagtaacttagctgtttaaacaaatccttaagacagttcaatagagcaaagtgaagaattactctattaggataacctgtgaacaaagttcagattatgtgaatttgtattccattcgaagtttggcaccagactgaacactggtttaagccaaattttttagtgttctagaagccctgaacatgttttccctcagattaaaagtagaacctttataatagaacctcattagcttgacactgagtatgctgagtgcaacttagcttaggtcaccagtatctcctacagaattccagttaatgaaagcagatcagccttgcggcaaagaatttgaaacctaggcaacatacaagtttgaagaaaaaaaaatcctctttggtgtgacaaagcacattccctccaggtatatggctcctgctccacttgcacccgaatcttgatcaaaggcagctggagaccaattcttgtctctccaataagattgctaggtttcaattccttaaaatatcaagccaaccaagttttattacatcaaatgtttctatcatttcaatgtgaaaatttttttacgcctatttgttattaaggtctcattatctgtgaaataatcacaaaaaaacagaggtgaatggtataagccactgctccaaaattaaccctatcgattctcgattcccactgtgcactttgtgaaaagggtaactgccaagaggtttaaccttgaagatgattactcaaacagtcagaacccataatatgagtttagatcaggcaaggagttcatgaggaagttatcaactcttgtgtgtccaaatctaaagccctgcatgggctctgtcaggtccttgtcacctgcactcaggtggccatcagacttcttgggtgcctggctatattcaatgtgaagtaaaaaatatcccaagtcttacaccaaaatagaggctctgacttagaagtatgcttttagctttctttttaaataagacattctggaagaaaaaaaaaagaaaaaggaaagaaaatcaagtttgaaacacagttaacacttattttggcaagaaagcaaccaaaatctaaaaagcataaactatgtgtccaaatgtaaaaggcattacagaacaaactgcaagaggggaaaattaaagccacactgaacgaaaaaatacagtatgtctaacattttggaattgtaatttaaaccctaagggcaaaagctgaaaaatcatgcttaggttgctagttaagtgcacccttccttgtttctcccaaataaaatcagtttattaattgcaccccaaagcaagttctctcagtacaaagtaactactacgtacacacaaaatgcttgttaatgtaataatttccctggctcatccaacgtgcaatgcacacgacttcaaagacaatttggggcaagtgtacatgaaatgagaaaacagctctccaagtttcaaatcctgctcttacattatttataggacactgaggtcatatttacttcttggttaagatgttgcactgtcatttcattatcagtctacctcacaatgtacattaccagatgccaatttgaggaactacagagataaaactttagtactttcttaatgggctgaataaattaattacaattaagtttgctttacatcctgttgaggacctctttgcagccccaggacctaacaatatctggcaggctccaagaatgctcatcaggtgaaatgatggcagaacatttaaagtaaggagccagttacttcagcttaagtcattcagagccaaacatctgaagaacgaccaaaatcaaacctttatttttataactgtataaatgtgatccaaatgtgtccaccactagtttttcaaaaagaaacatgctataaataagcaaactacatctgctcactgatgtgtatggactccctagatgtctcattgggcttaataacagaccactcacagtaatagatttttagtgtaaagtgtagcatgatgttaagccattttagcttttgcacatacatgttgcacttctggctgataatggaggaaaatttgcagcattatactgttaagctaggttgcatccatccctttaaatggcatcaatatcgatgtcgtcatccttgttgtctgactttacagtctcaactttcggtacactggcagccttcgaatacaccctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgangtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaaaatcacagggacccggcgggtggaggttgcagtgagttgagatcgcaccactgcactctggcctgggggtgacagagattgtctcaaaaaaaaaaaaaaaaaaaaaaaaagaaattgaacaaatttacatgagaaaaaattaaaagttaagttggatgggcacggtggctcacgcctgtaatcccagcactttgggaggccaaggnaggcggatcacttgaggtcaggagttcaagaccagcctggccaatatggtgaaaccccatctctactaaaaatacaaaaaaattagccgggtgtggtggagcgtgcctgtaatcccagctacttgggaggctgaggcaggagaatcgcttgaacccacggcaaaggttacagtgagctgagatcgtgccactgccctccagctggggtgacataacgagattccatctcaaaaaaccagtgccaggcatggtggctcatgcctgtaatcccagcactttgggaggctgaggcaggtggatcacctgaggtcgggagttcaagaccagcctgaccaacatggagaaacctcgtctctactaaaagcacaaaattagccgggcatggtggcacatgcctgtaatcccagctactcgggaggctgaggcaggagaatcgcttgaacccggcaggcagaggttgcagtgagctgaaatcgagccattgcactccagcctgggcaacaaaagcgaaactcctccaaaaaaaaaaaaaaaaaaagcaaagctgcacatttccagccatgcctaccacaaaatgatactagaagaaaatgatactaatgctaagagtggccccaagccctcacctagatgggggtggacggcatctctgcactggggcctagggaagctataggtgggggtctggctgcccagtgactgacctggttagtgtgggtggcctgcagaggacattcggggctttgcaaagagggtaacccatggagggcagccagccggcctcgggcaagggaagggcccggcatgggctctgggaaacactctggtgtcacctggcgcagtcttggcccaagtggccgcccacctgggccccagggaggatgcctgccagagcataggtggccctcgtgccctcctttacgggacccacatcaaaacctggaccagccccattccttggggaagctaaggacagaacaggccgggcctcaagtgttccccctgccttggcctcccaaagtgccaggattacaggtatgagtcactgcgcccggcctgttctgtccttggggaagctaaggac

SEQ ID NO: 12465 - DNA, 5577 bp, Homo sapiens
  misc_feature (4024)..(4024): n is a, c, g, or t
  misc_feature (4493)..(4493): n is a, c, g, or t
gcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtgacagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgangtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaaaatcacagggacccggcgggtggaggttgcagtgagttgagatcgcaccactgcactctggcctgggggtgacagagattgtctcaaaaaaaaaaaaaaaaaaaaaaaaagaaattgaacaaatttacatgagaaaaaattaaaagttaagttggatgggcacggtggctcacgcctgtaatcccagcactttgggaggccaaggnaggcggatcacttgaggtcaggagttcaagaccagcctggccaatatggtgaaaccccatctctactaaaaatacaaaaaaattagccgggtgtggtggagcgtgcctgtaatcccagctacttgggaggctgaggcaggagaatcgcttgaacccacggcaaaggttacagtgagctgagatcgtgccactgccctccagctggggtgacataacgagattccatctcaaaaaaccagtgccaggcatggtggctcatgcctgtaatcccagcactttgggaggctgaggcaggtggatcacctgaggtcgggagttcaagaccagcctgaccaacatggagaaacctcgtctctactaaaagcacaaaattagccgggcatggtggcacatgcctgtaatcccagctactcgggaggctgaggcaggagaatcgcttgaacccggcaggcagaggttgcagtgagctgaaatcgagccattgcactccagcctgggcaacaaaagcgaaactcctccaaaaaaaaaaaaaaaaaaagcaaagctgcacatttccagccatgcctaccacaaaatgatactagaagaaaatgatactaatgctaagagtggccccaagccctcacctagatgggggtggacggcatctctgcactggggcctagggaagctataggtgggggtctggctgcccagtgactgacctggttagtgtgggtggcctgcagaggacattcggggctttgcaaagagggtaacccatggagggcagccagccggcctcgggcaagggaagggcccggcatgggctctgggaaacactctggtgtcacctggcgcagtcttggcccaagtggccgcccacctgggccccagggaggatgcctgccagagcataggtggccctcgtgccctcctttacgggacccacatcaaaacctggaccagccccattccttggggaagctaaggacagaacaggccgggcctcaagtgttccccctgccttggcctcccaaagtgccaggattacaggtatgagtcactgcgcccggcctgttctgtccttggggaagctaaggac

SEQ ID NO: 12466 - DNA, 3680 bp, Homo sapiens
  misc_feature (2127)..(2127): n is a, c, g, or t
  misc_feature (2596)..(2596): n is a, c, g, or t
agtgacttaaggatcttcccgactagcccgacaggctctggaagtgtttcggcaagcccacccaacggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgangtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaaaatcacagggacccggcgggtggaggttgcagtgagttgagatcgcaccactgcactctggcctgggggtgacagagattgtctcaaaaaaaaaaaaaaaaaaaaaaaaagaaattgaacaaatttacatgagaaaaaattaaaagttaagttggatgggcacggtggctcacgcctgtaatcccagcactttgggaggccaaggnaggcggatcacttgaggtcaggagttcaagaccagcctggccaatatggtgaaaccccatctctactaaaaatacaaaaaaattagccgggtgtggtggagcgtgcctgtaatcccagctacttgggaggctgaggcaggagaatcgcttgaacccacggcaaaggttacagtgagctgagatcgtgccactgccctccagctggggtgacataacgagattccatctcaaaaaaccagtgccaggcatggtggctcatgcctgtaatcccagcactttgggaggctgaggcaggtggatcacctgaggtcgggagttcaagaccagcctgaccaacatggagaaacctcgtctctactaaaagcacaaaattagccgggcatggtggcacatgcctgtaatcccagctactcgggaggctgaggcaggagaatcgcttgaacccggcaggcagaggttgcagtgagctgaaatcgagccattgcactccagcctgggcaacaaaagcgaaactcctccaaaaaaaaaaaaaaaaaaagcaaagctgcacatttccagccatgcctaccacaaaatgatactagaagaaaatgatactaatgctaagagtggccccaagccctcacctagatgggggtggacggcatctctgcactggggcctagggaagctataggtgggggtctggctgcccagtgactgacctggttagtgtgggtggcctgcagaggacattcggggctttgcaaagagggtaacccatggagggcagccagccggcctcgggcaagggaagggcccggcatgggctctgggaaacactctggtgtcacctggcgcagtcttggcccaagtggccgcccacctgggccccagggaggatgcctgccagagcataggtggccctcgtgccctcctttacgggacccacatcaaaacctggaccagccccattccttggggaagctaaggacagaacaggccgggcctcaagtgttccccctgccttggcctcccaaagtgccaggattacaggtatgagtcactgcgcccggcctgttctgtccttggggaagctaaggac

SEQ ID NO: 12467 - DNA, 3289 bp, Homo sapiens
  misc_feature (1736)..(1736): n is a, c, g, or t
  misc_feature (2205)..(2205): n is a, c, g, or t
ccccccacctgccatcctgatatccccgcgtgcccgcagcgcgcgctataccagtcctcgcatgtggacgtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgangtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaaaatcacagggacccggcgggtggaggttgcagtgagttgagatcgcaccactgcactctggcctgggggtgacagagattgtctcaaaaaaaaaaaaaaaaaaaaaaaaagaaattgaacaaatttacatgagaaaaaattaaaagttaagttggatgggcacggtggctcacgcctgtaatcccagcactttgggaggccaaggnaggcggatcacttgaggtcaggagttcaagaccagcctggccaatatggtgaaaccccatctctactaaaaatacaaaaaaattagccgggtgtggtggagcgtgcctgtaatcccagctacttgggaggctgaggcaggagaatcgcttgaacccacggcaaaggttacagtgagctgagatcgtgccactgccctccagctggggtgacataacgagattccatctcaaaaaaccagtgccaggcatggtggctcatgcctgtaatcccagcactttgggaggctgaggcaggtggatcacctgaggtcgggagttcaagaccagcctgaccaacatggagaaacctcgtctctactaaaagcacaaaattagccgggcatggtggcacatgcctgtaatcccagctactcgggaggctgaggcaggagaatcgcttgaacccggcaggcagaggttgcagtgagctgaaatcgagccattgcactccagcctgggcaacaaaagcgaaactcctccaaaaaaaaaaaaaaaaaaagcaaagctgcacatttccagccatgcctaccacaaaatgatactagaagaaaatgatactaatgctaagagtggccccaagccctcacctagatgggggtggacggcatctctgcactggggcctagggaagctataggtgggggtctggctgcccagtgactgacctggttagtgtgggtggcctgcagaggacattcggggctttgcaaagagggtaacccatggagggcagccagccggcctcgggcaagggaagggcccggcatgggctctgggaaacactctggtgtcacctggcgcagtcttggcccaagtggccgcccacctgggccccagggaggatgcctgccagagcataggtggccctcgtgccctcctttacgggacccacatcaaaacctggaccagccccattccttggggaagctaaggacagaacaggccgggcctcaagtgttccccctgccttggcctcccaaagtgccaggattacaggtatgagtcactgcgcccggcctgttctgtccttggggaagctaaggac

SEQ ID NO: 12468 - DNA, 2885 bp, Homo sapiens
  misc_feature (1332)..(1332): n is a, c, g, or t
  misc_feature (1801)..(1801): n is a, c, g, or t
gcggccgctgaccccggcccctcgctcctgcatcatcgacaaggatgagctgaaggacggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgangtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaaaatcacagggacccggcgggtggaggttgcagtgagttgagatcgcaccactgcactctggcctgggggtgacagagattgtctcaaaaaaaaaaaaaaaaaaaaaaaaagaaattgaacaaatttacatgagaaaaaattaaaagttaagttggatgggcacggtggctcacgcctgtaatcccagcactttgggaggccaaggnaggcggatcacttgaggtcaggagttcaagaccagcctggccaatatggtgaaaccccatctctactaaaaatacaaaaaaattagccgggtgtggtggagcgtgcctgtaatcccagctacttgggaggctgaggcaggagaatcgcttgaacccacggcaaaggttacagtgagctgagatcgtgccactgccctccagctggggtgacataacgagattccatctcaaaaaaccagtgccaggcatggtggctcatgcctgtaatcccagcactttgggaggctgaggcaggtggatcacctgaggtcgggagttcaagaccagcctgaccaacatggagaaacctcgtctctactaaaagcacaaaattagccgggcatggtggcacatgcctgtaatcccagctactcgggaggctgaggcaggagaatcgcttgaacccggcaggcagaggttgcagtgagctgaaatcgagccattgcactccagcctgggcaacaaaagcgaaactcctccaaaaaaaaaaaaaaaaaaagcaaagctgcacatttccagccatgcctaccacaaaatgatactagaagaaaatgatactaatgctaagagtggccccaagccctcacctagatgggggtggacggcatctctgcactggggcctagggaagctataggtgggggtctggctgcccagtgactgacctggttagtgtgggtggcctgcagaggacattcggggctttgcaaagagggtaacccatggagggcagccagccggcctcgggcaagggaagggcccggcatgggctctgggaaacactctggtgtcacctggcgcagtcttggcccaagtggccgcccacctgggccccagggaggatgcctgccagagcataggtggccctcgtgccctcctttacgggacccacatcaaaacctggaccagccccattccttggggaagctaaggacagaacaggccgggcctcaagtgttccccctgccttggcctcccaaagtgccaggattacaggtatgagtcactgcgcccggcctgttctgtccttggggaagctaaggac

SEQ ID NO: 12469 - DNA, 3013 bp, Homo sapiens
  misc_feature (1460)..(1460): n is a, c, g, or t
  misc_feature (1929)..(1929): n is a, c, g, or t
cgaacgctcaggacgatgtagagagatccccggcggcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgangtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaaaatcacagggacccggcgggtggaggttgcagtgagttgagatcgcaccactgcactctggcctgggggtgacagagattgtctcaaaaaaaaaaaaaaaaaaaaaaaaagaaattgaacaaatttacatgagaaaaaattaaaagttaagttggatgggcacggtggctcacgcctgtaatcccagcactttgggaggccaaggnaggcggatcacttgaggtcaggagttcaagaccagcctggccaatatggtgaaaccccatctctactaaaaatacaaaaaaattagccgggtgtggtggagcgtgcctgtaatcccagctacttgggaggctgaggcaggagaatcgcttgaacccacggcaaaggttacagtgagctgagatcgtgccactgccctccagctggggtgacataacgagattccatctcaaaaaaccagtgccaggcatggtggctcatgcctgtaatcccagcactttgggaggctgaggcaggtggatcacctgaggtcgggagttcaagaccagcctgaccaacatggagaaacctcgtctctactaaaagcacaaaattagccgggcatggtggcacatgcctgtaatcccagctactcgggaggctgaggcaggagaatcgcttgaacccggcaggcagaggttgcagtgagctgaaatcgagccattgcactccagcctgggcaacaaaagcgaaactcctccaaaaaaaaaaaaaaaaaaagcaaagctgcacatttccagccatgcctaccacaaaatgatactagaagaaaatgatactaatgctaagagtggccccaagccctcacctagatgggggtggacggcatctctgcactggggcctagggaagctataggtgggggtctggctgcccagtgactgacctggttagtgtgggtggcctgcagaggacattcggggctttgcaaagagggtaacccatggagggcagccagccggcctcgggcaagggaagggcccggcatgggctctgggaaacactctggtgtcacctggcgcagtcttggcccaagtggccgcccacctgggccccagggaggatgcctgccagagcataggtggccctcgtgccctcctttacgggacccacatcaaaacctggaccagccccattccttggggaagctaaggacagaacaggccgggcctcaagtgttccccctgccttggcctcccaaagtgccaggattacaggtatgagtcactgcgcccggcctgttctgtccttggggaagctaaggac

SEQ ID NO: 12470 - DNA, 2767 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaaggttactagctccaaacacaaaataccttccgtgtttcctagcgagagagtgcgtgcgagtgagcgagagggaagcgagtgggcgcacgggagagatggtgggtgaggaggcccgtgcggatggccgcaagaaggctgccatctgggttcttggcagcgtagcctgctgttatcagccgaatgattttgatttttgctttgatttgtactgtatcattgtgataatatccccggctggctctttttgagctgttatatggactgcttttgagtctgcgtttctctccacttgccctcctccctgccctactttttttgatgtaattgtcatattttattgttattttgttatattattcttttttattttgtcttaacttttttttgtttttctatcgattttttttttgttgaatatcttacttataaatattataattaatcaatctctttttctttattatcaactattttattttttggtgtgta

SEQ ID NO: 12471 - DNA, 3276 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaaggttcctgctacagtatcaaaaggcagacactggaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgct

SEQ ID NO: 12472 - DNA, 3572 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaaggtaggggccgcgctgggagggggtgccgcagaagggtccctggggttccgtgagggaggggccctctcccctcccagcctagggaagcggcttcactgttaataaccatgtactcggctccaggcccgcccggagcccctgctaggacttagccacagcaggagctgggcacctgttcctttgtttcttaagagtcaactcttgctctgtcaccaggctggagcgcagtggcctgatcatggctcactgcagcctttacctcctgggctcacgttatcctcctacctcagcctccccaaatagctggatcttcagacacatgtcactgcacctggctaatttattgtttgtagagaggggatctcgctatgttgcccaggctgatcttgaactcctgacctttagtgattcttctgccccaacctcccaaaatgctgagattacaggcatgagccaccatgcttgaccacccgtatcttacagaggtccttactctcttttctcctgtctcagaagacgactttaaaagtgaataagatacctgggaccccaaaggaagacagtgatagtgaccatagttatcaaagtattgaaaagacccttctgtgatatggta

SEQ ID NO: 12473 - DNA, 3280 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaaggtaggggccgcgctgggagggggtgccgcagaagggtccctggggttccgtgagggaggggccctctcccctcccagcctagggaagcggcttcactgttaataaccatgtactcggctccaggcccgcccggagcccctgctaggacttagccacagcaggagctgggcacctgttcctttgtttcttaagagtcaactcttgctctgtcaccaggctggagcgcagtggcctgatcatggctcactgctcggccacgaggtaaggacaggatcctgagcaaagtccttgaaccacaaacacttcagtcaagcttgcccttac

SEQ ID NO: 12474 - DNA, 2199 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacatcacgttttctgcccacccagagaccccaggcttggttcgggctctctttgggcacgggttcggtggaggcttcccgaggaacattttgtaaatggaattctgtcgtgtgggcgtgtgacttgatgtttgtaccgcgattttggtaataccaagctttattaaacatatcgagttcatttttaactaaaaaaaaat

SEQ ID NO: 12475 - DNA, 283 bp, Homo sapiens
gcttgggtgactgagaccccatctcaaaaaaaaaacaaaaacaaaaacaaaactcacagaagcaggcctttctgataaaagccacagctcatctctgccaggaagcccccgccccagcttctcatctgttttgttttgcagacagagccgctaccctggaggaggggaacccaacagacgaggtccccagtacccccttagccctggagccgagcagcaccccaggttccaagaagagccccccagagcctgtggacaagcgagccaaggcccccaaggcgcg

SEQ ID NO: 12476 - DNA, 296 bp, Homo sapiens
aacagtgtctgttcttgggatgctgagatgtggggtgattttccttgggtgtctgagcctccatttgtcaacaatgaatctgttctgttccaggttcctgctacagtatcaaaaggcagacactgggtgagcctctggtattatagctggatataatagctgggtattcagctgttcagatgccaggaattggaaaccctgggcctccaacagaaggaactcttgggaaaggcccaaagaggcaatgtagtccagtggttaaggagccagaactgaagctaaagctacgtccccag

SEQ ID NO: 12477 - DNA, 4524 bp, Homo sapiens
acaattttatcattattttaatcaagtaacttagctgtttaaacaaatccttaagacagttcaatagagcaaagtgaagaattactctattaggataacctgtgaacaaagttcagattatgtgaatttgtattccattcgaagtttggcaccagactgaacactggtttaagccaaattttttagtgttctagaagccctgaacatgttttccctcagattaaaagtagaacctttataatagaacctcattagcttgacactgagtatgctgagtgcaacttagcttaggtcaccagtatctcctacagaattccagttaatgaaagcagatcagccttgcggcaaagaatttgaaacctaggcaacatacaagtttgaagaaaaaaaaatcctctttggtgtgacaaagcacattccctccaggtatatggctcctgctccacttgcacccgaatcttgatcaaaggcagctggagaccaattcttgtctctccaataagattgctaggtttcaattccttaaaatatcaagccaaccaagttttattacatcaaatgtttctatcatttcaatgtgaaaatttttttacgcctatttgttattaaggtctcattatctgtgaaataatcacaaaaaaacagaggtgaatggtataagccactgctccaaaattaaccctatcgattctcgattcccactgtgcactttgtgaaaagggtaactgccaagaggtttaaccttgaagatgattactcaaacagtcagaacccataatatgagtttagatcaggcaaggagttcatgaggaagttatcaactcttgtgtgtccaaatctaaagccctgcatgggctctgtcaggtccttgtcacctgcactcaggtggccatcagacttcttgggtgcctggctatattcaatgtgaagtaaaaaatatcccaagtcttacaccaaaatagaggctctgacttagaagtatgcttttagctttctttttaaataagacattctggaagaaaaaaaaaagaaaaaggaaagaaaatcaagtttgaaacacagttaacacttattttggcaagaaagcaaccaaaatctaaaaagcataaactatgtgtccaaatgtaaaaggcattacagaacaaactgcaagaggggaaaattaaagccacactgaacgaaaaaatacagtatgtctaacattttggaattgtaatttaaaccctaagggcaaaagctgaaaaatcatgcttaggttgctagttaagtgcacccttccttgtttctcccaaataaaatcagtttattaattgcaccccaaagcaagttctctcagtacaaagtaactactacgtacacacaaaatgcttgttaatgtaataatttccctggctcatccaacgtgcaatgcacacgacttcaaagacaatttggggcaagtgtacatgaaatgagaaaacagctctccaagtttcaaatcctgctcttacattatttataggacactgaggtcatatttacttcttggttaagatgttgcactgtcatttcattatcagtctacctcacaatgtacattaccagatgccaatttgaggaactacagagataaaactttagtactttcttaatgggctgaataaattaattacaattaagtttgctttacatcctgttgaggacctctttgcagccccaggacctaacaatatctggcaggctccaagaatgctcatcaggtgaaatgatggcagaacatttaaagtaaggagccagttacttcagcttaagtcattcagagccaaacatctgaagaacgaccaaaatcaaacctttatttttataactgtataaatgtgatccaaatgtgtccaccactagtttttcaaaaagaaacatgctataaataagcaaactacatctgctcactgatgtgtatggactccctagatgtctcattgggcttaataacagaccactcacagtaatagatttttagtgtaaagtgtagcatgatgttaagccattttagcttttgcacatacatgttgcacttctggctgataatggaggaaaatttgcagcattatactgttaagctaggttgcatccatccctttaaatggcatcaatatcgatgtcgtcatccttgttgtctgactttacagtctcaactttcggtacactggcagccttcgaatacaccctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattgga

SEQ ID NO: 12478 - DNA, 4825 bp, Homo sapiens
  misc_feature (3272)..(3272): n is a, c, g, or t
  misc_feature (3741)..(3741): n is a, c, g, or t
ctcaccccccaggatagagtacagtacacttggtggggtgggcggggggtgtgctggggactgggaggccggtgaagccggtgctagacactataatctaacaggatagagaagtgtttgttagggagagaagagggagaggcaggagccggcccaagcccaggtccctgcttgggccccagaaagcacttaaccaggccccaagccttcaagggaaaccaaggcctcaaccagacaatcttgagggaaggaaaagccagactttgggtttgttttttgggggaattattggttttttttttatgtttcttttggaattttgtttgttggcaaattctgtgtgatcttttttcataaaaaaaaagaaaagatttaatggggacaacacattaacaacaaaagacaaaaaaaaaaaaaaacaaaaaaaaacccaaaaccaaaaacgcttgcaggaagagagagaaggggtgttttgttcctcctgggagggcgcacttagggtggcacagaacttgggggtgagtgagtgagggggacaggggtgctgcctgtgctttccctgccgtttgatggctcctctctgctgcttcctcctccagaagaagaaagggaaagaggctgggccaggagctgggctgccgccgccccgagctcctgccttgccctctgaggccagggctcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaaacattctgacgtgcagaatattattttttatttcctgttagattatagtgtctagcaccggcttcaccggcctcccagtccccagcacaccccccgcccaccccgccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggttttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgangtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaaaatcacagggacccggcgggtggaggttgcagtgagttgagatcgcaccactgcactctggcctgggggtgacagagattgtctcaaaaaaaaaaaaaaaaaaaaaaaaagaaattgaacaaatttacatgagaaaaaattaaaagttaagttggatgggcacggtggctcacgcctgtaatcccagcactttgggaggccaaggnaggcggatcacttgaggtcaggagttcaagaccagcctggccaatatggtgaaaccccatctctactaaaaatacaaaaaaattagccgggtgtggtggagcgtgcctgtaatcccagctacttgggaggctgaggcaggagaatcgcttgaacccacggcaaaggttacagtgagctgagatcgtgccactgccctccagctggggtgacataacgagattccatctcaaaaaaccagtgccaggcatggtggctcatgcctgtaatcccagcactttgggaggctgaggcaggtggatcacctgaggtcgggagttcaagaccagcctgaccaacatggagaaacctcgtctctactaaaagcacaaaattagccgggcatggtggcacatgcctgtaatcccagctactcgggaggctgaggcaggagaatcgcttgaacccggcaggcagaggttgcagtgagctgaaatcgagccattgcactccagcctgggcaacaaaagcgaaactcctccaaaaaaaaaaaaaaaaaaagcaaagctgcacatttccagccatgcctaccacaaaatgatactagaagaaaatgatactaatgctaagagtggccccaagccctcacctagatgggggtggacggcatctctgcactggggcctagggaagctataggtgggggtctggctgcccagtgactgacctggttagtgtgggtggcctgcagaggacattcggggctttgcaaagagggtaacccatggagggcagccagccggcctcgggcaagggaagggcccggcatgggctctgggaaacactctggtgtcacctggcgcagtcttggcccaagtggccgcccacctgggccccagggaggatgcctgccagagcataggtggccctcgtgccctcctttacgggacccacatcaaaacctggaccagccccattccttggggaagctaaggacagaacaggccgggcctcaagtgttccccctgccttggcctcccaaagtgccaggattacaggtatgagtcactgcgcccggcctgttctgtccttggggaagctaaggac

SEQ ID NO: 12479 - DNA, 2817 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaaggttactagctccaaacacaaaataccttccgtgtttcctagcgagagagtgcgtgcgagtgagcgagagggaagcgagtgggcgcacgggagagatggtgggtgaggaggcccgtgcggatggccgcaagaaggctgccatctgggttcttggcagcgtagcctgctgttatcagccgaatgattttgatttttgctttgatttgtactgtatcattgtgataatatccccggctggctctttttgagctgttatatggactgcttttgagtctgcgtttctctccacttgccctcctccctgccctcctccccctcccccgagttccccccacccccgcactcacgttttctgcccacccagagaccccaggcttggttcgggctctctttgggcacgggttcggtggaggcttcccgaggaacattttgtaaatggaattctgtcgtgtgggcgtgtgacttgatgtttgtaccgcgattttggtaataccaagctttattaaacatatcgagttcatttttaactaaaaaaaaat

SEQ ID NO: 12480 - DNA, 4115 bp, Homo sapiens
  misc_feature (3977)..(3977): n is a, c, g, or t
  misc_feature (3982)..(3982): n is a, c, g, or t
  misc_feature (3985)..(3985): n is a, c, g, or t
  misc_feature (3989)..(3989): n is a, c, g, or t
  misc_feature (3998)..(3998): n is a, c, g, or t
  misc_feature (4003)..(4003): n is a, c, g, or t
  misc_feature (4035)..(4035): n is a, c, g, or t
  misc_feature (4085)..(4085): n is a, c, g, or t
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcgccgtgctgatcccctcaccttcactgggtgttcggtgttctccgcctcgggctgtcacaaatcgtgctgctgtgagccactgcgtgcaggtctcatcctgggtgtattttacaaacggactggatgtgagtgggtgaggagtgaagancttgngtnacangtgtttgtnttttnggttggttttggttttttgtttttggtttgtnttgtttttttttgtgggttgttttttttttgtttttagggggtttggagnttggttttgtgtatttaaaaatgtgtggag

SEQ ID NO: 12481 - DNA, 3243 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgct

SEQ ID NO: 12482 - DNA, 3208 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggaggtgaggctcaccgtgccctggttgggggctgtggggggctcagccatgctcctgtggtcagggcagggggctccacctgctcctctgtattcaccctcc

SEQ ID NO: 12483 - DNA, 1891 bp, Homo sapiens
gaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgcatagccgtagtcgtcgcagggcagcttcccgtcccacccgcagg

SEQ ID NO: 12484 - DNA, 464 bp, Homo sapiens
gagaagacaaatcctcattggaagaagacaccttcattctaggcctcagatagtttctgttaaacaattttacaaggacaagtagccatagggaaaagataagcctgaaagtaagtaagtcatgataagtaagcagaaactagaactgcaaggctatgttattactagtcacagattataaaactatgcctgctatcttctgaggaaataaaaggtaagcttgaaaatttctataggaatggacttagcaatagtgacaggtaattcagaactgtccttccactgatgacaataaaactagataaaatatgaaataaaactgaactgcaaacagagtagtgaataattactgggccaagatccagaaatttggcattttgggactaggtaccgttgatgatcaaaaagaagtggacatgagtttgattagtacttttgagactgtttgcaggactggtgagaaa

SEQ ID NO: 12485 - DNA, 375 bp, Homo sapiens
ggttgtgtcgttttgcacggaatagtagggagaagcctcctgatttgtttctctcgtggaaatttgatctgtatctgctaaaaaatgtttatcccttcttctgtaaaagggactctttcccctacggtgagtagtatatagtgaatatcaatgctgatacatttaaactgtggaggcatcaggggaccaacctgcagtgatgctaagtggaactgacaagataatgacatgcgggttattgttgattaatccagttcactggagaatcattgggaaatgcatttatcctttcacctgaccctcccaaccccacaaaaatgatttacagtaatcttggagtcacccagtcctttcttccacatcttccagaactta

SEQ ID NO: 12486 - DNA, 828 bp, Homo sapiens
cagctactcaggaggctgagacaggagaataacttgaacccaggaggcggaggttgcagtgagccgagattgcgtcactgcactccagcctgggtgacagagcgtgactccgtctcaaaaacaaagcacaaaagaaccacagatagaaggagcagctactctccttggtgctgagatagagtgccaaaggaagaggctcccactcactcatcctcagggctgagatctggccttcttggaaagggaacaacggtgctcactgagtggccgagaatttgctgtggtatgtcaccagacgaacttgcatggtatttgtactcccatgtgctggggaggtatctcatgggagacttcacacaacagaaccgtttgagagagtctctggagcaggctgctggccaccgagtactttaggatgctgggcactgcaggagcatgctgaggggatgcaccttctctcctacagcgtctcccccaggaccctgtactgacccatgctgcatgccctctgcctcctactaaatggctcccaaacagctgcaatttcacaaccaaagttttttacttgaaacagcatgttactccttgctaatctaattgagtgtgtattaatcggctacactggtcacacatttgattgggtaagacctaaagtaggctctgcttaacagtgagtccgttcatgtgacctataaaatctctctcagagactcctttccagtccatctttgtcagctgtcttgtctagagctttcaactagctcatagcctccagataacaaggtcattacctttagattaatacgtgcaagttaatacaaaaaaaaa

SEQ ID NO: 12487 - DNA, 294 bp, Homo sapiens
ctggctaatctaaatttaattctggatcttgtaatatatagtttaggagttcatttaaatttaatttacatagggtgaaaataagctttgacctttataattgctgtatcagtaaagtcacaggttcattgacttgttagccaatttttcctgtgttacttttcttctggttttgttgttgttgtttcagtttgtaatatacagatttaagaacaagtgtctggatatccacaaaggcatcacagacagctgacatgtggatctgcttttgtttgtaattaaaatgggcttaaa

SEQ ID NO: 12488 - DNA, 598 bp, Homo sapiens
tgtcaaatacatatgataatttcctaaagcactttttcaaaacatgtgtatttggggtcccccaataggtcaaatttcattttctgggggtaaggacccaggaagtgcatttcaaaaaagtttttcaggtaatttaataaatcctccctccaccctcagcccatttttttttccttcaggaaactgcttgccaagaagctaggcttttccctcccaatgtcatcactcagaaaatgacagtgagaaagacatggtttgtccatcagagctgggtcagagcatttatcagaagagaccagatggcctgaggtcttccctcagtgggtggatggccaaagggcaagtagcaatatttttacagcttcattctttgggcatttcccccatgcaaatgcataagaatgagaaataagtcagcacaatgcagggatttttttgtttgtttaatgtcagatcacatcatttgctgctgcacagccaaccattggcttgctttgaggaaggtggctccttggggagaaggggatctgagagaagcacagcaagaccagggcagaagtggggagtgaacccagcacatagagcgcagaccagtgtc

SEQ ID NO: 12489 - DNA, 3600 bp, Homo sapiens
agcggagttcaagttgcatacatgctgagccagcagctagaaccagaagccgaaagaactgttcacatggagctgtttattttccggcctgaggttgccgagacaattggcgagctgtcttgaatatatctctatcaattaaaacagcagctgagataaataatgcacctttgccggaactgccacagggactgcaggctcaggcttctcaagccagctcaccgtccagctgagcgagatgtcagcccaaggaaggaacttagatgccttggaaattgatgcctcacagttattttctccagaggaggtgcagggtctgggctagggaaacggaaaggactctgttgcatttaataaagcctgtatcctatggcagcagccactaaggagctcaccagaataagccaatgccattcctcatttggcctgagcagctcagagtcaggaagtcagagcgcagaaaatccagcagctgtcagagggctccatgtttggccacggtctgaagcacctgttccacagccgccgtcggtctcgggaaagggagcaccagacgtctcaggattcccagcagcatcagcagcagcagggtatgtccgaccatgactccccagatgagaaggagcgctctccggagatgcatcgcgtctcctacgccatgtccctgcacgacctgcccgcccggcccaccgccttcaaccgcgtgctgcagcagatccgctcccggccctccatcaagcggggcgccagcctgcacagcagcagtgggggcggcagcagcgggagcagcagccggcgcaccaagagtagctccctggagccccagcgtggcagccctcacctgctgcgcaaggccccccaggacagcagcctggccgccatcctgcaccagcaccagtgccgtccccgctcttcctccaccaccgacactgctctgctgctggccgacggcagcaacgtgtacctcctggctgaggaggccgaaggcatcggggacaaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaac

SEQ ID NO: 12490 - DNA, 2672 bp, Homo sapiens
atgaaccaggttgttcagcccttaatgagcagacactctgcatgtagaggcagccaggcccacctctcatgggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaac

SEQ ID NO: 12491 - DNA, 2805 bp, Homo sapiens
agcggagttcaagttgcatacatgctgagccagcagctagaaccagaagccgaaagaactgttcacatggagctgtttattttccggcctgaggttgccgagacaattggcgagctgtcttgaatatatctctatcaattaaaacagcagctgagataaataatgcacctttgccggaactgccacagggactgcaggctcaggcttctcaagccagctcaccgtccagctgagcgagatgtcagcccaaggaaggaacttagatgccttggaaattgatgcctcacagttattttctccagaggaggtgcagggtctgggctagggaaacggaaaggactctgttgcatttaataaagcctgtatcctatggcagcagccactaaggagctcaccagaataagccaatgccattcctcatttggcctgagcagctcagagtcaggaagtcagagcgcagaaaatccagcagctgtcagagggctccatgtttggccacggtctgaagcacctgttccacagccgccgtcggtctcgggaaagggagcaccagacgtctcaggattcccggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaac

SEQ ID NO: 12492 - DNA, 2717 bp, Homo sapiens
ccagtgctgcccagtgtctgtgaccccgggggcctgacacagtccgcagacagctggggcctcagagccccgggtacctcatcgccggcacggcttcgggaaacagtgcccacacaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaac

SEQ ID NO: 12493 - DNA, 3736 bp, Homo sapiens
ggccggccgggagggatgcgctgtgccgcccagctcctctccgtcctgcccatgccctgaagcagaaagtttgggggccgggggttgtctcccttctccctcctgcaatgactgcccaaggactcttgctgcccagcctcgactgtgacctgtcttcgctccccaggtcgaaatgaactattccaagctataaccaaggctcccccttctcgcccctccctcacccgcctttaagaattttttttttaattcaagaaattgtggtctgccatctcccctccttgttaataatttagaccccaggcctcatatgaatataagagggggtgcggtcttccccaagacggcgcgctggaaggacagattccccttgccgacccacatacaccatgaagaggtgcagatcggacgagctgcagcaacaacagggcgaggaggatggagctgggctggaagatgccgcttcccacctgccgggcgcggacctccggcctggggagaccacgggtgctaactctgctggcgggccaacttcagacgccggcgctgccgcggcgcccaacccaggtccccgaagcaagcctcctgatttaaagaaaatccagcagctgtcagagggctccatgtttggccacggtctgaagcacctgttccacagccgccgtcggtctcgggaaagggagcaccagacgtctcaggattcccagcagcatcagcagcagcagggtatgtccgaccatgactccccagatgagaaggagcgctctccggagatgcatcgcgtctcctacgccatgtccctgcacgacctgcccgcccggcccaccgccttcaaccgcgtgctgcagcagatccgctcccggccctccatcaagcggggcgccagcctgcacagcagcagtgggggcggcagcagcgggagcagcagccggcgcaccaagagtagctccctggagccccagcgtggcagccctcacctgctgcgcaaggccccccaggacagcagcctggccgccatcctgcaccagcaccagtgccgtccccgctcttcctccaccaccgacactgctctgctgctggccgacggcagcaacgtgtacctcctggctgaggaggccgaaggcatcggggacaaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaac

SEQ ID NO: 12494 - DNA, 2803 bp, Homo sapiens
atccatgtctttctgaacgacagttctgctgtgagaagctgccattagagagatccagcaggccccaggactcagctggccagccggtgacactgctcactgctcattgtcctcagctgtggacctctgtccccctctgctggccactcacagaatttcctgctggcactgtcaagatgaagtccaaggaggaagagactgctgtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaac

SEQ ID NO: 12495 - DNA, 2727 bp, Homo sapiens
atgaaccaggttgttcagcccttaatgagcagacactctgcatgtagaggcagccaggcccacctctcatgggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacaaaaaaaataaaaaactttaaggggggcccggtacccaatttgcccttttattga

SEQ ID NO: 12496 - DNA, 3501 bp, Homo sapiens
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcggcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgttttacctacagagcaattcaactcatgcttatttatagtactaacttttaatatgatctttaactaaatcctatatttgaaatcatacacaaggactcaagagagatattgtgtaactaggatgcattttccaatgagatatcttgcagtttctgttctgggtagatttttttctctcatatgcaccacccttactgtatattcagtcctatactcttattcagggatttaactatggtcgtagcatagggctgaagtgttgtgaatatgatgaaaatgtgatgagaccaaacaaaccatggggcacagtagagcatcactcctgccaagtggtctttgtatggcatgctggctgcaaataaaggagatctgggacacttaactaggcttttaaagtacagacagtgcacagttctcatttgggtggaggctgcatgatctgtgggcactagcagagaaagtggttgcctctgtgcagaatgcatttatgagtagaggctccaccttctctgtccatgtaaaccctctaggtaattactgccccattcccaggccacctagatctctcttctctagtctcccttagtcttttctctttcctgaagtttagaaaataacttctacaatcacagaaaggaaagctttaactcaaactcaaattactttccattcttctgaggaccaggactataatcctataaagcctaaaacttgactgcatttttctctctgctcctctgctatgacattatatcctcaaagctactcagggtaaatgacttactaaaaaaaaaaaaatgacagattgaaaaatcaagaataattcattaatacaaaacattatcctactacaattgtttcaggatgtgtattattcagagttcttcatggcaaataacaatctgctcagcaatttaagtaaaaagtaatttactttttaataccattaggttgcacaccgatgctccagaattgtgagggagccatactctacagctattccaccgaggataatactaccattgtaaaggcatctcacgggaaaacaacacagctaccatgaaccagcaccatgatctctggatgaaatgctggaagcttctgcagtgtcagctatgagtaaatggatgccaccaccttcacattttcagtaaacaaatactcccctaccccatgaaaagttgcatctttgagctgctcacatctccagctaagcctcacaaaagtcaatctgcagggaagaatctaaatcatatgcctacccatgggaaagtctgagaattagagtatttttgtcttctacttttggaggaagaaactaataacgtgggaaattttcctgtatgtttagtcaacccgtttttccatgcagatgtatggagataaatcttatagta

SEQ ID NO: 12497 - DNA, 2040 bp, Homo sapiens
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcggcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatca

SEQ ID NO: 12498 - DNA, 846 bp, Homo sapiens
aggattacttcctcggtggtactcccccaggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatca

SEQ ID NO: 12499 - DNA, 844 bp, Homo sapiens
gtgtagtgtatccgggaactccaggcaggctgcctgactccagtgtttgtgctcagaactattcctgaaatgagagacttggaaagataaaagtttcgtatgaaatagtgcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatca

SEQ ID NO: 12500 - DNA, 2262 bp, Homo sapiens
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcggcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggttgcacaccgatgctccagaattgtgagggagccatactctacagctattccaccgaggataatactaccattgtaaaggcatctcacgggaaaacaacacagctaccatgaaccagcaccatgatctctggatgaaatgctggaagcttctgcagtgtcagctatgagtaaatggatgccaccaccttcacattttcagtaaacaaatactcccctaccccatgaaaagttgcatctttgagctgctcacatctccagctaagcctcacaaaagtcaatctgcagggaagaatctaaatcatatgcctacccatgggaaagtctgagaattagagtatttttgtcttctacttttggaggaagaaactaataacgtgggaaattttcctgtatgtttagtcaacccgtttttccatgcagatgtatggagataaatcttatagta

SEQ ID NO: 12501 - DNA, 1869 bp, Homo sapiens
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcggcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcagaacaggaacgccttctccaggagggtttcttagcgatagtgggtaccgagctcg

SEQ ID NO: 12502 - DNA, 923 bp, Homo sapiens
aaatacaaaagaagaatgaggtgatgatggaacagaaagagaagagttatcaggaacacgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatca

SEQ ID NO: 12503 - DNA, 720 bp, Homo sapiens
  misc_feature (34)..(34): n is a, c, g, or t
gttttactccctttggacgactctagaggatccnccaatcccttggagcctttcgctaaagctaagaaaaggtactgataagaaaagtaaaagctttaatgatccacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatca

SEQ ID NO: 12504 - DNA, 1460 bp, Homo sapiens
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcggcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggatttaggttacatgggggatcctcacgattcgacct

SEQ ID NO: 12505 - DNA, 241 bp, Homo sapiens
tggctgatgcacttctacagactgatcagtcactctcagaaaaggaaaaagcgattgaaggtgagaacagctgaaaacactctacatggtcggaaagctctcaaaatgttagttagcaatattggtccacctggaattattattgtagagaaagaatggcaagtatcattcatagttctatgagagttttcttaactaatctgtatgatcattggttttctggttacccaaggcaaaatta

SEQ ID NO: 12506 - DNA, 884 bp, Homo sapiens
catagaagtcttctctactggggtcgttctggcttttgttagaaactaggtctgagatgtttcttccctgtccattaccattcgatgttcttttattcagagcaatgttgcgtgtattctgaaactggaaactgaaccagttgtttctcctagtcaccaagcatactctcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcgcgcgcactagttgttgaagtcttcctgattttatattgagccttcttctatcaattttgagagcaagtattgaaatccctaactatgtttttgttgaattgttcacttttaagtctgtttttgcttcacttgacttttggctcttttgttagactgtttcataattgttacatcgttctgatgtattggttcttttgtcattatgaaatattcctctgtctctattttgtgtcatactaataaaatcactctggttttcttatggttacagtttgtattatgtatcttttccacaattttactttcaactaacttgtgattttgaatctgaagtgggtctcttagatgcatataattaggtcttgcttttttatacagttggataacctgtaccttttaaatttgaatgactttacgcttaaggtaattattgctatggttgcatttatgtctgccattttgagtttttaaaatgttctttacattcctttgttactccttcactgcattcttttgtgttgaataaatatttttagtgtgccatttta

SEQ ID NO: 12507 - DNA, 1167 bp, Homo sapiens
gagaaagaaatgttcaaaagcatttagcaaagaaagtacatgaagtgcagtcagattgctctgggaattcagggatgagagtaactaatttacattttaaaatggtagttcttagaggcccagcaaggaaaggaccatgaaggcagaatgtttcagtgtgtcttgaacagtgagtaggacttataactgatggaaataggggcatttcaggcagaaagaataacttgaagaaaatgaatagggcatgtgcagggaccatgaataggggaatgtcgctgtgtagcacataatacgtgaacaagactgttgtgtactgcagtccaacaggaataaagaaataagactaaaaacttatacagttgactcttgaacaacatgggactgtaggggtccacttagagttttttctaatacattggaaaattttttggagatttgcagcaattggaaaaaactcacagatgaactgtatagcctagaaatatatttttttaattaagaagagttaggcatgtcttgaatgtgtaaaacatgtgtagatacttgtgtattttatcatttactaccacagaatatgcacaaatctattataaaaaattaaaattttatcaaaacttgcctatacaatatgcagatcatacatgaagccattcatagtcaagagaaatgtaaacaaatgtaaagatgcagtattaagtgagagtggcaaaaagttactgtggtatatactatacttctctaataatttcatagccacctcctattgctattgcagtgagttcaggtgctgcaagtatccacttaaaatgccacacattttaatcggcactgatcacctctgtttcagcagtttgtctctgtagtaaattgcctaccacagtaaaaggtaatctcttgtggttctcatgtatttttcatcgtgtttaatgcaatactgtaaactttgaataataccataagactcgtataaagtgatgccactagcactagtgatactggaagtgctcccaagaagaagagaaaagtctgacattacaagaaaaagttgaattgcttggtatgtaccatagattaatgtctgcagctgctattctgccatttcaagaaaaatgaatgatgtctgccatttcaggataaatgaattcagtgtaaggactattgttaaaa

SEQ ID NO: 12508 - DNA, 559 bp, Homo sapiens
caagaaaaagatatgaatgaaattgcatggggaagagtggcctattctaagggaacagcttaactaagtttttattactattggatgttgtaataactatgtatttttttgtatataagctataactcatactatttcagtgggtgatgagtgatgagatgggaagtatatttaaataaaaataacttgctaatataattagatagcattaaggaagtatgagtaaggtatattccttttagcctagaattgcttcctttcatggcttcaagagtaggatttcaaagtcacttattatattattatatacagaaaaatgtaaacttacttaaggtcagactaattccttgcttctgaaatgatgaaagtattaatgctaaaaataatagataacatggaagtttcaaagtgttgttgaaatggatggaaggatgaaggctcattaaactttgtgaacaagaatttagtggaaaaattaagtatggagcagaattttgaagatgtgttgaacatggtttggcagagaaggcagaaaccttcatttagcagaaaccacatg

SEQ ID NO: 12509 - DNA, 1162 bp, Homo sapiens
tttagactcatcactttcgccagtcttctctttctccccccactttttttttttcattttgccacatcatgcgactcggggcgaccgacgtcacttccgtgggcgctttaggtcccacccacgtacttccaggtgcacgtgatactgatggggaagggtcggctgattgctgccagaaatggagagctcgttttaaggaaatgcggcgtctcctgggagtgaagaggcttttgggccaccttgaggcatgacgggtgccgcttcgtttccctgcgaccgctgcctgtttcgactgagcccctcacaggaggacgtggcgggggcagacgggcgcagcctcccgccctctccgtgactcagggaaacggcctcgccgcagagcgctccctcggcagctggctgcagcactcctcccccgccgggcttcagagtgggtggtttcctacagcctagggagggggcctgaaacggggtttaaaatcttccctgccctcacacaagcccttctgactgttggagaacctgacgcgcggattctaactagaactggcactctcttcgggtgttagataattaactcaaaggacagcgaaggccttttatgatgtctttcaagctggccttatgacagcttttcttaacgtttctgcggacattttggcggacttgtgtcggcctagctcagtgatcagtttcgttaaagaatttgagtatccgaacattaaaggattggacctaaattctagcaggaggatttttagccacatcaaataatttacgtctcaaagatttagataattagggtaaggatgcttagtaaaacctgaaggttccatcgcgccactgcactccaacctgggcgacagagcgagactccgtctcaaaaaaaaaacaaacaaaaaaaaacctgaaggttcctggaggaaagagatgaactattagccgtgtatttcggtgggaccacctcaacataggttcctgtaggttagcaatgtagaaatgtagcgcttcaaagccggagcatcctgtcttcaaagagcatgaaggtatcaacggcattcattgtcgattaataataaccttcctggtactttcttgctaaagtataagccataataatatttcataatcgcaccaatacaataaaggatgaaagacgtta

SEQ ID NO: 12510 - DNA, 482 bp, Homo sapiens
tactactactaaattcgcggccgcgtcgacgtatccgaacattaaaggattggacctaaattctagcaggaggatttttagccacatcaaataatttacgtctcaaagatttagataattagggtaaggatgcttagtaaaacctgaaggttccatcgcgccactgcactccaacctgggcgacagagcgagactccgtctcaaaaaaaaaacaaacaaaaaaaaacctgaaggttcctggaggaaagagatgaactattagccgtgtatttcggtgggaccacctcaacataggttcctgtaggttagcaatgtagaaatgtagcgcttcaaagccggagcatcctgtcttcaaagagcatgaaggtatcaacggcattcattgtcgattaataataaccttcctggtactttcttgctaaagtataagccataataatatttcataatcgcaccaatacaataaaggatgaaagacgtta

SEQ ID NO: 12511 - DNA, 1049 bp, Homo sapiens
tttagactcatcactttcgccagtcttctctttctccccccactttttttttttcattttgccacatcatgcgactcggggcgaccgacgtcacttccgtgggcgctttaggtcccacccacgtacttccaggtgcacgtgatactgatggggaagggtcggctgattgctgccagaaatggagagctcgttttaaggaaatgcggcgtctcctgggagtgaagaggcttttgggccaccttgaggcatgacgggtgccgcttcgtttccctgcgaccgctgcctgtttcgactgagcccctcacaggaggacgtggcgggggcagacgggcgcagcctcccgccctctccgtgactcagggaaacggcctcgccgcagagcgctccctcggcagctggctgcagcactcctcccccgccgggcttcagagtgggtggtttcctacagcctagggagggggcctgaaacggggtttaaaatcttccctgccctcacacaagcccttctgactgttggagaacctgacgcgcggattctaactagaactggcactctcttcgggtgttagataattaactcaaaggacagcgaaggccttttatgatgtctttcaagctggccttatgacagcttttcttaacgtttctgcggacattttggcggacttgtgtcggcctagctcagtgatcagtttcgttaaagaatttgagtatccgaacattaaaggattggacctaaattctagcaggaggatttttagccacatcaaataatttacgtctcaaaaaaaaaacaaacaaaaaaaaacctgaaggttcctggaggaaagagatgaactattagccgtgtatttcggtgggaccacctcaacataggttcctgtaggttagcaatgtagaaatgtagcgcttcaaagccggagcatcctgtcttcaaagagcatgaaggtatcaacggcattcattgtcgattaataataaccttctgggtttttattttgggaatgcgttttccatgggcacctaattgtgccgcttctaacaattga

SEQ ID NO: 12512 - DNA, 270 bp, Homo sapiens
ggaagaccagaagaaaggaagagaggagttgcaaaacaaccagaaaataaggaacaaaatggcagtagtaagttcttatcaataataacactgaatgttaatgaactcagttctccaattaaatagcatagaattttctttagccaggcatggtggctcatacttgtaattccagcactttgggaggctgaggtgggaggatcactggatcacttgagcccaggagttcaagaccagcctgggcaacataacaaggctccatctctattt

SEQ ID NO: 12513 - DNA, 325 bp, Homo sapiens
cacttctggccttcctagtcagcctgatgtgggggatttaaggacttcagggaaggtggagcctctgctgtgtgcagctgcgagctcctcattttcctggcaagatagggtgtctccaaggacaggaacctttaagattccagcgcagtgggacaagaggatctcgtgtgctgccgtgtcaaatgctggagcaggggagcgcggggctgttgtggaaacccttgctatttttacctcctgtctccgcagcttctgcctcccactgaaatcccagtgagcagcagcagccccctgggcccctggcgtgccaggtagggctattttt

SEQ ID NO: 12514 - DNA, 452 bp, Homo sapiens
aggaggatatctcagtcaggaaggcgcttggtgtgaatatggattaggccctggctgctgctcaggaagtcaggactgcagtgggggtagagtggaagcaaggaccagttagcccattagcttcgacctgggatgatggagactgagagactggattccagaggagtttagagggtaaacctgacatgcctagtgcttgattggacatggatggggtgaggacaggggcgaggcaggtgtcatggcttccatctcctgcaaaggcagagatggggggctgatttagaggagaaaggtcatgtgtttagactggaactgttaaaggctggaactgttaaaggggaggttctttggagaattccaggcaggtggggatggggatggctgttgggtccagcagggtctggagctcagaggaggggtctggactggagcactgtgatggagacagg

SEQ ID NO: 12515 - DNA, 2098 bp, Homo sapiens
  misc_feature (339)..(339): n is a, c, g, or t
  misc_feature (357)..(357): n is a, c, g, or t
caaccgcgccgtctgtccctggcaagccagcggcggtttaaaggaggtggcgggaagcctgtgtgtgcttcaaatcgtcaccctcatggtcgctccggtttttcacgactgaaaataacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttntttgcttcatgaaagganattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgccctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttaattatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagcttgtgtttacatgaaatatgtttattatcaagaattcctttttccaattctgtacattaaatatatgtgttttaaagggtttgg

SEQ ID NO: 12516 - DNA, 2046 bp, Homo sapiens
gacgctcgacgggattgggcgccggcgggtgaggttatcactaggcgccgaggaggggagcgggaagcgcagtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccgaagctaaatattgaacatggagaaaaagtgaactggctcttgggtacaaaaataaagggacaccaaaatgctgggattacaggtgtgagccaccacgcccagcctaattctctttttctaatagttgcactttatcatattttacaaatgtgtgagtctgctatggattagaaattaataagagattttgccacagatagtttgagaagcccagcactgccactcaacaaatgctggtgcattcagatggtgaaatattctgcagctattaaaggagttaaaactgcctccacttacctggaggcccatctgtgacacctttttaggttaaaaggaaaagaaaaacttgcttaggactgaatatgagcggttgcaatttgtaacaatgatgtatatatacatatacattttcatgtatttgtatgaacataaaagtattgaaggatattcatcaaactgctaaaagggttgcttcagagtaacggactcggagaaggcagattaattttctcttaatggaactctgtattgtatcacttgtaaaaataagcatgtgttatctttatgataaaaaagtaaaaacct

SEQ ID NO: 12517 - DNA, 1724 bp, Homo sapiens
gacgctcgacgggattgggcgccggcgggtgaggttatcactaggcgccgaggaggggagcgggaagcgcaggtatgaggctggcgccggtggcttcgatgctgctttccggtgacttcgatgctgttttccagtgctttttcctttttctgtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccgaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaattgtggcaaaactgtttttcagattaaaaaaaaa

SEQ ID NO: 12518 - DNA, 1369 bp, Homo sapiens
  misc_feature (25)..(25): n is a, c, g, or t
ctgccgagagctccaccgctgaggncaacgaggccatttgtttattacatctgtctcctcccatcaagtcgatgtataaaacatgagattacagttgtttcccccacttcacagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccgaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaattgtggcaaaaaaaaatatagaacataaaaaaaaagattaaagaaaaaagaaataacaaaaataaatatatacacgcaaatcagaggaagaggtgaaaaaaaataagacaaaagaggggggtgggccattattcgagtg

SEQ ID NO: 12519 - DNA, 1524 bp, Homo sapiens
gacgctcgacgggattgggcgccggcgggtgaggttatcactaggcgccgaggaggggagcgggaagcgcaggtatgaggctggcgccggtggcttcgatgctgctttccggtgacttcgatgctgttttccagtgctttttcctttttctgtgccagcgccacagcccttcaatcattttggttgctatccagcttctccacatcaagtccaacttcagaaaccccaagcctgtagagaaaagttgacctgtgctgactctggtgatgagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccgaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaattgtggcaaaaaaaaatatagaacataaaaaaaaagattaaagaaaaaagaaataacaaaaataaatatatacacgcaaatcagaggaagaggtgaaaaaaaataagacaaaagaggggggtgggccattattcgagtg

SEQ ID NO: 12520 - DNA, 831 bp, Homo sapiens
gacgctcgacgggattgggcgccggcgggtgaggttatcactaggcgccgaggaggggagcgggaagcgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccgaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaattgtggcaaaaaaaaatatagaacataaaaaaaaagattaaagaaaaaagaaataacaaaaataaatatatacacgcaaatcagaggaagaggtgaaaaaaaataagacaaaagaggggggtgggccattattcgagtg

SEQ ID NO: 12521 - DNA, 252 bp, Homo sapiens
gcgccggtggcttcgatgctgctttccggtgacttcgatgctgttttccagtgctttttcctttttctggtctggtggctccgcgtctgctctcctgggctccctttcctgtgacgtttccctgtgtccgttaggtccttgcttcagactccagctcaacgcatgaaacttttctctccttgcttgccgggtcctggctccccaacctttttgtgtagcttgggcagcggaggccgtctttacctggtcagg

SEQ ID NO: 12522 - DNA, 2126 bp, Homo sapiens
gacgctcgacgggattgggcgccggcgggtgaggttatcactaggcgccgaggaggggagcgggaagcgcaggtatgaggctggcgccggtggcttcgatgctgctttccggtgacttcgatgctgttttccagtgctttttcctttttctgtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccgaagctaaatattgaacatggagaaaaagtgaactggctcttgggtacaaaaataaagggacaccaaaatgctgggattacaggtgtgagccaccacgcccagcctaattctctttttctaatagttgcactttatcatattttacaaatgtgtgagtctgctatggattagaaattaataagagattttgccacagatagtttgagaagcccagcactgccactcaacaaatgctggtgcattcagatggtgaaatattctgcagctattaaaggagttaaaactgcctccacttacctggaggcccatctgtgacacctttttaggttaaaaggaaaagaaaaacttgcttaggactgaatatgagcggttgcaatttgtaacaatgatgtatatatacatatacattttcatgtatttgtatgaacataaaagtattgaaggatattcatcaaactgctaaaagggttgcttcagagtaacggactcggagaaggcagattaattttctcttaatggaactctgtattgtatcacttgtaaaaataagcatgtgttatctttatgataaaaaagtaaaaacct

SEQ ID NO: 12523 - DNA, 1829 bp, Homo sapiens
gacgctcgacgggattgggcgccggcgggtgaggttatcactaggcgccgaggaggggagcgggaagcgcaggtatgaggctggcgccggtggcttcgatgctgctttccggtgacttcgatgctgttttccagtgctttttcctttttctgtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccgaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaattgtggcaaaaaaaaatatagaacataaaaaaaaagattaaagaaaaaagaaataacaaaaataaatatatacacgcaaatcagaggaagaggtgaaaaaaaataagacaaaagaggggggtgggccattattcgagtg

SEQ ID NO: 12524 - DNA, 1725 bp, Homo sapiens
  misc_feature (1693)..(1693): n is a, c, g, or t
gacgctcgacgggattgggcgccggcgggtgaggttatcactaggcgccgaggaggggagcgggaagcgcaggtatgaggctggcgccggtggcttcgatgctgctttccggtgacttcgatgctgttttccagtgctttttcctttttctgtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccgaagctaaatattgaacatggagaaaaagtgaactggctcttgggtacaaaaataaagggacaccaaaatatattagtagctgatcaaactagttgtatatctgtataccccttaaatgaattttaaatccaataaaaacgtaccggcaggtntttttttcctgtatctattaaccgaaacctga

SEQ ID NO: 12525 - DNA, 1260 bp, Homo sapiens
gacgctcgacgggattgggcgccggcgggtgaggttatcactaggcgccgaggaggggagcgggaagcgcaggtatgaggctggcgccggtggcttcgatgctgctttccggtgacttcgatgctgttttccagtgctttttcctttttctgtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgcttttgcacagagtacttggggaatttctaagtgggatttgctaacaggatcaaattattgatcacacgaaatatctttgctttttctgttttctactaacatatccatttatgaacaataagccttatttctacatttaatgctagtctgataaaacctaatagaatttattcacaaagtaat

SEQ ID NO: 12526 - DNA, 610 bp, Homo sapiens
agagccctttctttggagcattatttgtgatggtttagattctctgtctcttcctaagtgtctctaggcattgagtgtatatttattgttccctttacctaaaatgtccttttctctcctgtcttctgtctggtgattgcccactccttttaggcctggcttaaatatcacctttccttggtaactctccttaacacttcttaacttcctcttacaccaatttaactgcttcctcatctgtgtttccatagtgcttaatacattcttgtatgcataaaaaatcacattgcaatttgtggtttgtttgtttgtttaagccaaggtcttgttctgttgcccaggctggaatgcaatggtgtgaacacagctcagtgcagccttgacctactatgctcaagtgatcctcctgcctcagccccccaagtagcaggaactacagatgtgtgtctccaagcctaatttaaaaattttttttgtagatatgaggtctcactcatatgctgcccagtctagtctcaaactcctgagctcaagctgtcctcccaccttggcctcccaaagtgctaggattataggtgtgagccaccacacccagctcacattgcatttt

SEQ ID NO: 12527 - DNA, 473 bp, Homo sapiens
atcctgcggctttttatcgtcatggtatactgtgtgttttgccggcaaaacaaaatacattaattaagtactaatcgattttatttaaaaaaatgaattaacagcatacaatcaattgcccacttagaaatgcagatcaacagaacataaggtaaccagtggaactacactgagttatatatattccagcccaaagcaaataaacttaaatatttctttaatcttgcctgtgttgcctgggacagcctgattacagggcagaatttgaattatgccaggccttatgaaatgttcagcagggctatagattcctatttctcatttactggatctcaggtgcctgtaatcccagctactctggagactgaggcatgaggatcactttaacctgggaggcggaggttgcagggagccaagattgcgccactgtgctccagcctgggggatagagtgagactcccttcaaaaaaaaa

SEQ ID NO: 12528 - DNA, 371 bp, Homo sapiens
aaaacatcaccactggcctatgcaaggcccgcctgattatacatttatgtgtatgtgtgaatatgtaatatgtacataaagatatatacattcaaatacattcctgtaagcagtatttctgttgtctgtttacatacattttaggattgcatagtttattgtgctctaatgctttctcattctattgtacttttgctcagcatttttttaaaaacttgtctctgttaataggtgcaccttttctctatcttttagtttctcagtattgttctccagagattgactttgagattgcatccagggccttgtcatcacaggataacaccagaatgaatatccttgcatactttcccttgtgtgagaatatcttt

SEQ ID NO: 12529 - DNA, 369 bp, Homo sapiens
actcctcttcattttctattcttgcctggagttagactgtatttctcatgccctaactagacttgttccctggttgtcagtacttttcctgacacatcccacccctgtttggcccctcattttctttagtttactattatttctcctcttcattattctcctaccttatttgatcttcctagtcccagtaagcagagcaactagagggcccaacagagtaccctcatgttttggaagtgtggatagtgactgacggtgaacctacaggccacctgctcatggcacctgctttgtaattcaaaggtgaagtctgtgctttgatacacaaaagtgctgccttggttttatcactaactcccctttaacttc

SEQ ID NO: 12530 - DNA, 333 bp, Homo sapiens
ataatttgagtgtatatggattcctgagttttaaggacctgtctcctttataggctatagcgccttgagagcccagccatctcattccacccaaaactcacagagccctgcttattcactggcagttaactggcactaacagatatcagtaaaattaaaaagtgttggctttattgaagcaaaataacacaagtattttagtgagtagaagaatatatgcatatatattcacacacacatctgtagacatacacttagaggatatagaatttgtgtatacatttctttgcctgtttcccctgatatccatttaaaaagaaatagaaaaactat

SEQ ID NO: 12531 - DNA, 463 bp, Homo sapiens
taagtgtggatgggaagcagttggagggttttgaggaggggtggtgtgatctgacccgcattttagaatcatcccgttggctgaagtgtggaggaaaaaagcagggggcagaagtagaggtgaggggcagccagttaggaggctacaggagtagcccagaccagacaggagggtggctcggccctcagagatcttggtggggcagattagagagtgatcaagttagagctaacaggacttttttttttagactgggtctcgcttgttgcccaggctgtagtgcactggtgcaatcatggctcactgcagccttgacctcctggatcaaggtatcctcccacctctcagctgctcgggaggctggggctggagaattgcttgaacccgggaggcagaagtagcagtgagccgagattgcaccgctgcactccagcctgggcaacagagtgagactccatctcaa

SEQ ID NO: 12532 - DNA, 314 bp, Homo sapiens
gcctgcctcctacacaggtggaaacttgtccttgtgtcctcttctccagcccaaaacttgatccttacatgacagggccaggagacctggatgcagggctcaaagctgcccagactgccgggcgaggtggctcacgcctgtaatcccagtactttgggaggccaagctgggaggatcacaagatcaagaccatcctggccaacatggtgaaaccccatctctactaaaaatacaaaaaattagctgagcgtggtggcacgggcctgtagtcccagcaactcgggaggctgaggcaggagaatcacttgaacccg

SEQ ID NO: 12533 - DNA, 952 bp, Homo sapiens
ttgcagtaattcccaccgtggaggtttgtggaaagaccgctttccatggagagtaaaggccggctggaaagtccccaagcgtcactgctacaacatggtgacctcctggagaacagggacgtgtggtgtttctctttgtatttgtcttttgttcccagaacagggattgtcaatgaggtagatcagattcccattcgacgggcaaccagtcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctgttctttcatttcccccttccccattcctttattgtacgtaaagtaactggtatatgtgcacaagcatattgcattttttttttttaactaaacagccaatggtatgttttgactgacatcaaggggagacgggatggggaaaaatactgattctgtgaaaataccccctttctccattagtggcatgctcattcagctcctatctttatattccagtaagttattttgctctcactgttttaacaacaacaacaaaacaacaacaacaacataaaaatccttgcataccttgttcaattggagaattttaatgtttttcatttatcattgtaaaaccaaggacaattttataacttttttgtacgtagctgttacatgtagggtaatctgtctttaagtaaggataaattactctaaaacaaaaaagaatcctacatagttttcccttcaagtcaagcgtcttgttgtttaaataaaccccgatgcggccggggacaatttatttaaacgatcctcccacccgcccccacctcg

SEQ ID NO: 12534 - DNA, 400 bp, Homo sapiens
gaatgggctatttctgttgttctgttcatttttgacaggattcagtctccagggagttgaaaaacttgatatcaaagtattatattttacatttttattgtgttttgatcaataccaataatttagaatagttggaagtgttttaagcactgtagtgtatatactattcctaaatccataaattgatgagtgctctgttaattggttgctttcaaaataatggttaaaatatagaaagaatattaaaatccttgaggtctgtacttttttaaactatttaatagcaccaatatctccattatgtggaggtgaagaaggcaagatgtgagccaccatttatagctccttcaagaactggcccacaataattagctttaaaagtagggccaggtgaggtagc

SEQ ID NO: 12535 - DNA, 347 bp, Homo sapiens
gcttgcagctggtactcttgattgcatttcatgctttggcacaaatgcacagaagtacaacacaaaaagggaatggagttctatgttcctgatctcttcacattagacttcatctcaccaaaatggcataaaaggtgtggctacaacatttgcatacaaatttcatgcaaaagaggtaataacattagtagaggaaaagaagatctgccattaacaggtcacttttggatgaatttgtacatgactttaagtgatgatcctcaactcatttaagattaaagagccaagcatattgcagtggacatacagaaaagtcatgataatcattgaggatttactaagactct

SEQ ID NO: 12536 - DNA, 423 bp, Homo sapiens
aggagtaggaggcccacccagtcccaccacacataccgggacatctttgaccacatgggtcctctgccgttcgtattttagcttagatgttcttaactgaactaacttccaattttcatatacactgatcatcttgtccctagcattttccctccaagatcctgctaacaggcaaactagccctttcaaacagttggtacctgagatttctcagagctctcttatcaagagtaaggagtgagattgcagaaggggcagtaatgtcaataccaagttattggaaactacttaaccagccactgcattacatactggagcccgtctaggacacttgcccttggaaatggtggaaagactttgttttatttctatttcatcaacagaacttttgtagcattgaatctaagcaaaggataacatcat

SEQ ID NO: 12537 - DNA, 298 bp, Homo sapiens
gcaattttatgcccaggttagactagggatttggctgatgttctggaatctcattgtactgttaagtaatgagcatgctcaatgacacaccctgtcaggggttgtgagaaagctgcagtgttcagtttcccacccgtttccttttcctgctgtctctctctgactcattcctgcttcttactttcccttttccttctttgtccaaacattacatttctaggcaaagataaaagaggaaatagtgatgtcctgaaagggattcagaacaaagtagcatggcctttggtgaaagcttcac

SEQ ID NO: 12538 - DNA, 801 bp, Homo sapiens
cttcaaaaatttttggctagattagatcctttgcctttccatatgaattttagaatctgcttgtcaacttctgtaaaaaatcctgcaagtatttttgattaggattcattgaatctatacgttaatttgggaagaattatcatcttaaaaatattgagtcttccaacacacatatgtataatttcatcttcttaggtcttctttagttttttttcaccaatgtcttactgttttcagtgtgcaagtcttatacattcttggctaaatttatctttaagtatatcattgtttttgatgtggttataaatgatattggtttttaaatttcaatttccagttgtttgttcctaatatatgaatatgcaatcaattttgtatactgattgggtattcttcaaccttgctaaactccctacttcagttctagtagtttttcgtagattctttaagattttctacatagatgatcatatcttctgagaatatagacagttttacttctttcttttcaacttatattctgttacctttatttatttcactggctagaacttccagtaatacgttgaataaaggtagataaagcagatatttgtgctttagtcctaatcttaggaaaaaaggcattaggtcatttacatgtatgatgtaaatgttatgatgtaaaatgtattttaactgtgatgttaactgtgaattatcttagatgctatatcaggttgaaaattcccttctattctttgttgttgagagatttttataataaatagatattgaattttgtcaaatacttggtataca

SEQ ID NO: 12539 - DNA, 3764 bp, Homo sapiens
ggcctcaacatataattagaataaactgtcttcttgttctactcagggcctttaggtgtgttcattcacggtatggaaatacagtaaatgaaagattccaactagttgtcagtgcttcttgaaattccaaacagaaagatacattggtcaaatccaacacttggcttatcaatattaagtcttttacctaaaggcccagccgtcaccagacaacagaataatcaatctgcctgaaaatccctcctccttgtcctacactttttgcctgtttgggagaatatctttgtactccattctcctccctcagccagttactgggtcacccatccatgtgttcatgaatcaatcatcacggcctgcagagcacctgtcctaaggagggaaaatcctgtcacactgcctctccccattcgtgtgtggttttcttgatcggtgagatctgtctctgaagtcactgccagcctccctgggaacgtctatagtgcctcccctgccttatgtgatgggagttaacaactcagataagtacacctgagagcatttctatcaggtaaactgtcacttaaatggaggtgtccacatcttaattgtttctccttgacacatttctcaatccacgaagccaggagaggtagagtgaaaatcccagccatggatgaatgtactaatttgaaagccaagtgttaagtcggatgttttcccgttacactactactcagccctctcctgcggccacatcaacggatgcaagtcacagtcttaacacagcctgtgggagacaagcagtttgtgtgctcacagtatatattatagtaattagggtgacttagagcaaatactcttcagatcctatgtagtcagtgaaacaaaatggagagcgtattctgatagaaggacgtcgacggtgaatgttctggtggttgttgcctgttaagtaaactttagtgtgtaagttgagtttgtcattaaaatcataaaccagctgcggtaacagacaagcctttggctggggagttttaagcctcggtaactgctataaaactagccatccagttaggatagaatgtgtttctttctggttaaaaaaaggaaaaaccatctaagaaaatatatatgtatgtatgtgtgtatacagtggaattcaaaggaccaaagcaaaatttgaacaggaatctattaatttagaattttataagatatttattaataaatgttatttttaaacattccatttgaacagtattctgtaggatctacttgtttttaaagtgttagtccataataaactactatagttatgtgtattttcatttttcagggtttcaaatggctattctccatcatttggtggaaatgtttgcttagatctctgtgcatagacatttcaaggatttttattgctctgtgagttattttttaatcaacattctgaacagttttttttaaacatttatttctgtgtgttcatttttaaagtaagctctttcatttaggaagcagagttcagctaaagggaatcagtaactctaactggaacagctttcttgtagaagtgtaaaaacagcttcatctctgcctctctccaccccaccccaatttcctagaaagccttgcactattcagctcccttagtgctttttgtcccttcccgaacaatatgcagtagctttaagccattcaagctccattatgcagtatatctgagaagggaaaggaaacaacccatttaaatttgaataaaaccgtgcctatgcgaacagtagcaatttagaatctcttttctgcttttaaaataatttatatttaaaaattgcactttagctttttgatccctttgtatttctcttattctctttctaacctcttctctgtcctcaaacttgcctttgctctcctttacaataccccccacccctcctccaaggctctgagcggcatcatttaaaaattactttacagatatttgcaccaggtacatttatgtgcgtccattggtagcacagctgagacctgtgtctcacatcagcctaggtgaagcctactacaagaatgccaaggagaagagccagtacactatatggtttatactctttatccctttattcatagcatgttttttaaaaatgttatattatgcaacagatgtgaggcagcagctaagctatacttaagaattttctctcaccttccaaaccaaagtgtcctgaataagccaggagacttattcttttgtgcaccctggtgcacatctgactgttgtcctagccatagactctctgaggccactgaaagaacagtggccctatcgatttcattcctaggtctcaaaaatacaatgttgccttgtaacataattagggacagcacctctatttcacaattataatctaaggtaggataagacgacacagcagcaataaacttacaagtaaaattcaataccaaaacaaacacaaagaaatttaaaaaacaaaaaacctagctcatcatgttgtgaaaatgaaaaagtgaatgtccattcaaaatattttactatttcttgtgggagttttttcagtgatgtaatgcttgtagccaaattgcttaaagagtgtttatatatttttttccttataaattgtctattttttaaaaaagctatttaaccacagctgaagtggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaaacagcaaagcatttgtgtttgtttgtctatttgtaaagcaaccaccttccttattggaaggagaaaaaaaggggtacatacatgtaaatacttgctgcagcatttaatatgtttaattttgtgttaagctttttgttgcatcgtgaacacatttattgttaccaatggacaatgagttcattaagactgttcaactaggtcagatttttacatctctttctagcaagaagagacaagattttgtgcatttgtacaaatgttaatatcactgcaattccaatataataaagcactcaaatgcaaataaaaaaaatca

SEQ ID NO: 12540 - DNA, 3710 bp, Homo sapiens
ggcctcaacatataattagaataaactgtcttcttgttctactcagggcctttaggtgtgttcattcacggtatggaaatacagtaaatgaaagattccaactagttgtcagtgcttcttgaaattccaaacagaaagatacattggtcaaatccaacacttggcttatcaatattaagtcttttacctaaaggcccagccgtcaccagacaacagaataatcaatctgcctgaaaatccctcctccttgtcctacactttttgcctgtttgggagaatatctttgtactccattctcctccctcagccagttactgggtcacccatccatgtgttcatgaatcaatcatcacggcctgcagagcacctgtcctaaggagggaaaatcctgtcacactgcctctccccattcgtgtgtggttttcttgatcggtgagatctgtctctgaagtcactgccagcctccctgggaacgtctatagtgcctcccctgccttatgtgatgggagttaacaactcagataagtacacctgagagcatttctatcaggtaaactgtcacttaaatggaggtgtccacatcttaattgtttctccttgacacatttctcaatccacgaagccaggagaggtagagtgaaaatcccagccatggatgaatgtactaatttgaaagccaagtgttaagtcggatgttttcccgttacactactactcagccctctcctgcggccacatcaacggatgcaagtcacagtcttaacacagcctgtgggagacaagcagtttgtgtgctcacagtatatattatagtaattagggtgacttagagcaaatactcttcagatcctatgtagtcagtgaaacaaaatggagagcgtattctgatagaaggacgtcgacggtgaatgttctggtggttgttgcctgttaagtaaactttagtgtgtaagttgagtttgtcattaaaatcataaaccagctgcggtaacagacaagcctttggctggggagttttaagcctcggtaactgctataaaactagccatccagttaggatagaatgtgtttctttctggttaaaaaaaggaaaaaccatctaagaaaatatatatgtatgtatgtgtgtatacagtggaattcaaaggaccaaagcaaaatttgaacaggaatctattaatttagaattttataagatatttattaataaatgttatttttaaacattccatttgaacagtattctgtaggatctacttgtttttaaagtgttagtccataataaactactatagttatgtgtattttcatttttcagggtttcaaatggctattctccatcatttggtggaaatgtttgcttagatctctgtgcatagacatttcaaggatttttattgctctgtgagttattttttaatcaacattctgaacagttttttttaaacatttatttctgtgtgttcatttttaaagtaagctctttcatttaggaagcagagttcagctaaagggaatcagtaactctaactggaacagctttcttgtagaagtgtaaaaacagcttcatctctgcctctctccaccccaccccaatttcctagaaagccttgcactattcagctcccttagtgctttttgtcccttcccgaacaatatgcagtagctttaagccattcaagctccattatgcagtatatctgagaagggaaaggaaacaacccatttaaatttgaataaaaccgtgcctatgcgaacagtagcaatttagaatctcttttctgcttttaaaataatttatatttaaaaattgcactttagctttttgatccctttgtatttctcttattctctttctaacctcttctctgtcctcaaacttgcctttgctctcctttacaataccccccacccctcctccaaggctctgagcggcatcatttaaaaattactttacagatatttgcaccaggtacatttatgtgcgtccattggtagcacagctgagacctgtgtctcacatcagcctaggtgaagcctactacaagaatgccaaggagaagagccagtacactatatggtttatactctttatccctttattcatagcatgttttttaaaaatgttatattatgcaacagatgtgaggcagcagctaagctatacttaagaattttctctcaccttccaaaccaaagtgtcctgaataagccaggagacttattcttttgtgcaccctggtgcacatctgactgttgtcctagccatagactctctgaggccactgaaagaacagtggccctatcgatttcattcctaggtctcaaaaatacaatgttgccttgtaacataattagggacagcacctctatttcacaattataatctaaggtaggataagacgacacagcagcaataaacttacaagtaaaattcaataccaaaacaaacacaaagaaatttaaaaaacaaaaaacctagctcatcatgttgtgaaaatgaaaaagtgaatgtccattcaaaatattttactatttcttgtgggagttttttcagtgatgtaatgcttgtagccaaattgcttaaagagtgtttatatatttttttccttataaattgtctattttttaaaaaagctatttaaccacagctgaagtggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaaacagcaaagcatttgtgtttgtttgtctatttgtaaagcaaccaccttccttattggaaggagaaagtgttaagctttttgttgcatcgtgaacacatttattgttaccaatggacaatgagttcattaagactgttcaactaggtcagatttttacatctctttctagcaagaagagacaagattttgtgcatttgtacaaatgttaatatcactgcaattccaatataataaagcactcaaatgcaaataaaaaaaatca

SEQ ID NO: 12541 - DNA, 2090 bp, Homo sapiens
aggacacacacagcctacacaggcatacacacacaccacatacacactacacaccgggacacacacacaaaaggcctatgcatgtgcacacacatacacacggacacatacatgcacacacacgggcctgcagctctgaaaggactcatgactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 12542 - DNA, 834 bp, Homo sapiens
  misc_feature (753)..(753): n is a, c, g, or t
  misc_feature (830)..(831): n is a, c, g, or t
gtctgcagccgcggcagtttttagagcacatgccggtcctactgtcacacgggttctgactgacctcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctccaactcagcagacccatcaccttctcccgctacatccggcccatctgcctcccttggaanccaaacggccttcctttcccccaaacggggctttccaactggcaacttggccacttgggccttggggggtcaatggnnggg

SEQ ID NO: 12543 - DNA, 361 bp, Homo sapiens
tcaagcttctaacgatgtacggggacatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 12544 - DNA, 287 bp, Homo sapiens
gtgtgaagctggagaggcctgtccgggggcactgagaactccctctggaattcttggggggtgttggggagagactgtgggcctggaaataaaacttgtctcctctaccaccaccctgtaccctagcctgcacctgtccacatctctgcaaagttcagcttccttccccaggtctctgtgcactctgtcctggactccggaggactgagcccccaccggaactgggctggcgcttggatctggggtgggagtaacagggcagaaatgattaaaatgtttgagcacaa

SEQ ID NO: 12545 - DNA, 1887 bp, Homo sapiens
gtctgcagccgcggcagtttttagagcacatgccggtcctactgtcacacgggttctgactgacctcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 12546 - DNA, 2416 bp, Homo sapiens
  misc_feature (2372)..(2372): n is a, c, g, or t
aggacacacacagcctacacaggcatacacacacaccacatacacactacacaccgggacacacacacaaaaggcctatgcatgtgcacacacatacacacggacacatacatgcacacacacgggcctgcagctctgaaaggactcatgactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaaaaaaaaaaaaaaaaaaaaaaaacaaaaaaaacaaaaaaaaaaaaaaaaaaaaaaaactcagcagcgagatttttgttgtggtgcggggcgggaaaaaaggagtaaaaataaagagcggcggcagggtggtaaatataggttgtgtttcgtgcgaacccaccgtgtttttttgtcagacagggggagtaaaacacggcgggggccccccatatgaggggggggggcataaaactgcagataagcgagggttttacccttttatattatgtcgtgtacataacnagttgatgaaatggaagggacgaagtagaagaatacaggatgga

SEQ ID NO: 12547 - DNA, 1996 bp, Homo sapiens
aggacacacacagcctacacaggcatacacacacaccacatacacactacacaccgggacacacacacaaaaggcctatgcatgtgcacacacatacacacggacacatacatgcacacacacgggcctgcagctctgaaaggactcatgactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggcctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 12548 - DNA, 1885 bp, Homo sapiens
aggacacacacagcctacacaggcatacacacacaccacatacacactacacaccgggacacacacacaaaaggcctatgcatgtgcacacacatacacacggacacatacatgcacacacacgggcctgcagctctgaaaggactcatgactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggcctggcgcttggatctggggtgggagtaacagggcagaaatgattaaaatgtttgagcacaa

SEQ ID NO: 12549 - DNA, 1599 bp, Homo sapiens
ctaggtagaggcctgggtttaatcggccgagggtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 12550 - DNA, 1466 bp, Homo sapiens
aggacacacacagcctacacaggcatacacacacaccacatacacactacacaccgggacacacacacaaaaggcctatgcatgtgcacacacatacacacggacacatacatgcacacacacgggcctgcagctctgaaaggactcatgactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaacctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 12551 - DNA, 1132 bp, Homo sapiens
cgagctcggttcccttgctcttttgggggctttgctcttttggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 12552 - DNA, 1021 bp, Homo sapiens
  misc_feature (926)..(926): n is a, c, g, or t
  misc_feature (1003)..(1003): n is a, c, g, or t
  misc_feature (1006)..(1006): n is a, c, g, or t
aggacacacacagcctacacaggcatacacacacaccacatacacactacacaccgggacacacacacaaaaggcctatgcatgtgcacacacatacacacggacacatacatgcacacacacgggcctgcagctctgaaaggactcatgactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccaagggcgacattgcactcctcctgtctcaacctcccaagtaggattacaanatgcgccgacgatgcccagaatccagaactttgtctatcactctccccaacaacctagatgtgaaaacagaataaanccnctcgttcctgaatta

SEQ ID NO: 12553 - DNA, 292 bp, Homo sapiens
agtgtcagttctaagtctggaaggaccagttaggagtgaaggtgaggggtcagaggttacatgataaaactaaggtgcaatttgagacctaaaaggggctgatcggaatcaggggttggcagtgggggttggggaacaaggagaggtctcctgggtctcagcctttgccccctgcctgcagcgagcaccacaaggaagcctatgaggtcaagctgggggcccaccagctagactcctactccgaggacgccaaggtcagcaccctgaaggacatcatcccccaccccagcta

SEQ ID NO: 12554 - DNA, 351 bp, Homo sapiens
ttgtgctattcagatatgaattaaaggaggagaagcagttcgagaggtggcgtggagaacctgaaggagcattcagggtttgaggtagcttaattaacaggaaactacaaatgcaggtctggaacacaagaaaagtatggactggaaaataaagatcttggagttgtcagtaaatagatggtagatggaactgctgggagtgagttttgcccaaggaaaacaatatagaatgggatcaagaaagagaagctagcaaaggacaataagaagttgtcagagaagtagggaaagaactagagataggtcttgtaagtccagggagataaatatattttaagtgtcggatacctt

SEQ ID NO: 12555 - DNA, 780 bp, Homo sapiens
  misc_feature (89)..(89): n is a, c, g, or t
cttggccagatggtatcaaactcctgacctcacgtaatccacccaccttggcctcttaaagtggtggaattacaggtgtgaaacacgcnacccagccattagcttgaatttataatgtttataaccttaaacatctgccagacataatattagtttattaaatgagtaaaccccatctctactaaaaatacaaaaaaaattagccaggcatggtggtgcatgcctgtagtcctagctacttgggaggctgaggcaggagaatcactggaacctggaagatggaggttgcagtgagctgagatcactccactgcactccagcctgggtgacagagtaagactccatctcaaataaataaaaaataaatgcttgtaaatagagttttcatatattttaaaatcctgaaatttttaaattaagtaataattgcttgttggatgtctgggccatttctaattaagaaaaaattaagtaaagaaaaacgtgtttctaaaatcatggaggccgggcacaatggcttacacctgtaatcctagcactctgggaggtcaagatgggcagattacttgaggccaggagttcaagaccagcctagccaacatgacaaacacccacctctacagaaaataaaaaattagccgggcatggtagtacatgactgtaatcccaactacctgggaggctgaggcacgagaattgcttgagcctgggaaatggaggttgcagtgaaccaagaccacaccactgccctccagcctgggcaatagagtgaatccatgt

SEQ ID NO: 12556 - DNA, 561 bp, Homo sapiens
  misc_feature (542)..(545): n is a, c, g, or t
  misc_feature (552)..(553): n is a, c, g, or t
catccatgtctgttcttagctaagagttccagcctcagtacagctggattaccctttggacagaagggcagacaacctcaaggtcagcagcaacagaagttgggcctagtagtcagatcacaagtgagtgtggctattcatgagaatagggtggtggtggcatttatcctgcttcccctccataaataaacctggtaattttatttttaatgttacaaaaaaagttgatgctacattaaatgttttaccctcatccattatcataaatctcatactggaggtgtgatctctcttcttgtttctttaattgaaagtaccaatgaatcgaggcctggtggatgatgcctttagagttttttgttttgttttgtttttgttttcttgaatcattgaaacttgtcatttttatctagactcttccacaaatggcaaagtcacttatctgcagaattcccagaatcttcttttgcctttgtgcacctgctaattaccccctctgaactgaatttgaaaaaattaattaaaataaccgaatcaccccnnnnacccccnntagagcca

SEQ ID NO: 12557 - DNA, 934 bp, Homo sapiens
ctgccccactctcctctcacctaccaaaggattttctcaggtgtggttccaagcgataaagttctactgtcctcggccttccctgctggtaattcgcctttcagattagccaataacactgagctgatctctagggttaagaagagaacattgaactcattttgtccccatgtaccccacaggcttgaaacagaaaatgatgtaaacttttgtggcatacattcacccattttcccaccatatctttactatcctgtgttgatttttttttcaaattacaaagacaatacatgttctttgtgggaaatctgaaaaatactaccaaatagaaaataaaaatcacctgaattcaccacgaccacattgtttaaaaccacatttctgggttttaaatcagtcagtggctgggcccaaaggcacttttgggtaagataagtgaagaaatgcccacaaggccaaggtgtcacttaaaaaaacaaacaaaaaaaacaagccaaaaaaaaaaattctgtccgctaatgttttgcacgcatctaggagcagactcactgcaaacctctggttatgccattattcaggggtataaagaaagctttagaagtagcatagtcctgatgcctcctctaatgagttaaagctcttgggggaaattctaaaattgccagaccattttgtttctctgtgctcctacgaaaccagtcgggatactgagtgtttggcaatactgccacctactgaaagctgagcttcagagtgaggtgaaataaagacagaatgtaaaagcatctactttgttttaaacagcaaacaaatggaccagattaacaatgatcccatctggaatttaaaactctgaaagtgtcaacattgaaaggattaagcatatcatccggtcaaacttcccaccctacccacatacccaggcaacgtctat

SEQ ID NO: 12558 - DNA, 377 bp, Homo sapiens
gcaagagcaatttggaggttaacagcaagatggagttgattaggtcagatttctttcactgtcataattttgtcactgttatttttgcaaaggtggtttcaccacaaaaagctttcgtgatctggcccccttgcctacctgattagcttaaccttctgcttttcctcttaaactcatacaggctactgtccattggattatgaattccttgaagtcagaaatgatgtatttccaaggcctagcacagtaactcgcatatgcttggtaaatgctacataaattaattagcaatataaaattctaataaggtcacagtgtgagagaacactgaaaaacatgtgctagtttctcatctctctgctttccattgctaagta

SEQ ID NO: 12559 - DNA, 8437 bp, Homo sapiens
ctcagctccctgtggtgggggatggcagaggcttcccgctccccgcagctggtttgcacagcctcccgactgtgccgtggtgtctccttccctaaagtgggacagtcgtttctgtgtcctgctggcctctgaggaacagacgtgtgtgagaggccttcagggcctgatggctggggtggtgacagtgcctggagaatgggtggggactggaggggccaggtggctaaccactctcctcttccatggcagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatacaaaaatgtcgccttgggtttttgttttgtttttctttgtctttcagcaacaaggcacatgcatggggaaaatgctgtgtgttttaagacctgtctcaaagaaatacttcctgtggctccctagctaaacttcccactcagcttgtagtcactctgacttttcaaaaaaatcactacttcatattctactagaagcaattctggtcagatcatgattcgtttcccaatgctgggttctacacaggtcattcagacagtcatcaggtcccctcatgcaaggagtccccagagaaactgctcaccccacctgaggcgcccagggaggactttctagatgcctcaaa

SEQ ID NO: 12560 - DNA, 8384 bp, Homo sapiens
ctcagctccctgtggtgggggatggcagaggcttcccgctccccgcagctggtttgcacagcctcccgactgtgccgtggtgtctccttccctaaagtgggacagtcgtttctgtgtcctgctggcctctgaggaacagacgtgtgtgagaggccttcagggcctgatggctggggtggtgacagtgcctggagaatgggtggggactggaggggccaggtggctaaccactctcctcttccatggcagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatacaaaaatgtcgccttgggtttttgttttgtttttctttgtctttcagcaacaaggcacatgcatggggaaaatgctgtgtgttttaagacctgtctcaaagaaatacttcctgtggctccctagctaaacttcccactcagcttgtagtcactctgacttttcaaaaaaatcactacttcatattctactagaagcaattctggtcagatcatgattcgtttcccaatgctgggttctacacaggtcattcagacagtcatcaggtcccctcatgcaaggagtccccagagaaactgctcaccccacctgaggcgcccagggaggactttctagatgcctcaaa

SEQ ID NO: 12561 - DNA, 9028 bp, Homo sapiens
ccgagccccggaggaagcaggcgtgtgttgaatttctctctgcccctcaccttggaataaacaggaagcgacaagcacccagcccggcccggcacttgcctttgtgaaggggtctgccctgcacagcctttaggaagcttcctcgggaccccttcccggtgcgccgccccgggtgggcctgggggcgcgccctcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatacaaaaatgtcgccttgggtttttgttttgtttttctttgtctttcagcaacaaggcacatgcatggggaaaatgctgtgtgttttaagacctgtctcaaagaaatacttcctgtggctccctagctaaacttcccactcagcttgtagtcactctgacttttcaaaaaaatcactacttcatattctactagaagcaattctggtcagatcatgattcgtttcccaatgctgggttctacacaggtcattcagacagtcatcaggtcccctcatgcaaggagtccccagagaaactgctcaccccacctgaggcgcccagggaggactttctagatgcctcaaa

SEQ ID NO: 12562 - DNA, 8907 bp, Homo sapiens
ggcagcagggccggtggccgctggagccgcactgcgggcagtccccgcctccgctccgggggggcggcccagcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatacaaaaatgtcgccttgggtttttgttttgtttttctttgtctttcagcaacaaggcacatgcatggggaaaatgctgtgtgttttaagacctgtctcaaagaaatacttcctgtggctccctagctaaacttcccactcagcttgtagtcactctgacttttcaaaaaaatcactacttcatattctactagaagcaattctggtcagatcatgattcgtttcccaatgctgggttctacacaggtcattcagacagtcatcaggtcccctcatgcaaggagtccccagagaaactgctcaccccacctgaggcgcccagggaggactttctagatgcctcaaa

SEQ ID NO: 12563 - DNA, 8629 bp, Homo sapiens
ccgagccccggaggaagcaggcgtgtgttgaatttctctctgcccctcaccttggaataaacaggaagcgacaagcacccagcccggcccggcacttgcctttgtgaaggggtctgccctgcacagcctttaggaagcttcctcgggaccccttcccggtgcgccgccccgggtgggcctgggggcgcgccctcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggca

SEQ ID NO: 12564 - DNA, 8903 bp, Homo sapiens
actggacgtccgcgagcctgcgccgtcggctggtgccggagtggttatgctgggcgccgagcgcgatgcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatacaaaaatgtcgccttgggtttttgttttgtttttctttgtctttcagcaacaaggcacatgcatggggaaaatgctgtgtgttttaagacctgtctcaaagaaatacttcctgtggctccctagctaaacttcccactcagcttgtagtcactctgacttttcaaaaaaatcactacttcatattctactagaagcaattctggtcagatcatgattcgtttcccaatgctgggttctacacaggtcattcagacagtcatcaggtcccctcatgcaaggagtccccagagaaactgctcaccccacctgaggcgcccagggaggactttctagatgcctcaaa

SEQ ID NO: 12565 - DNA, 8903 bp, Homo sapiens
cggccgcagcgccgcgtcccctctctccccgcgctgaggctgcggaccgggcccggcgggattagcagcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatacaaaaatgtcgccttgggtttttgttttgtttttctttgtctttcagcaacaaggcacatgcatggggaaaatgctgtgtgttttaagacctgtctcaaagaaatacttcctgtggctccctagctaaacttcccactcagcttgtagtcactctgacttttcaaaaaaatcactacttcatattctactagaagcaattctggtcagatcatgattcgtttcccaatgctgggttctacacaggtcattcagacagtcatcaggtcccctcatgcaaggagtccccagagaaactgctcaccccacctgaggcgcccagggaggactttctagatgcctcaaa

SEQ ID NO: 12566 - DNA, 8779 bp, Homo sapiens
acgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggca

SEQ ID NO: 12567 - DNA, 8726 bp, Homo sapiens
acgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggca

SEQ ID NO: 12568 - DNA, 8556 bp, Homo sapiens
acgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaaaaaaaaaataaaaaaacttgag

SEQ ID NO: 12569 - DNA, 8069 bp, Homo sapiens
acgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttgcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggca

SEQ ID NO: 12570 - DNA, 7613 bp, Homo sapiens
  misc_feature (33)..(33): n is a, c, g, or t
  misc_feature (75)..(75): n is a, c, g, or t
caaggggaatatgcacacgtagcacgcacaganactcgcaggagcccaagctttccattacccacagctctccantgctcagccctcctggatgcgctgggatttggcaaggtgagtggtctgtcataaggaatcagaaaagtacacttttttttctggaattggattttcctgtattcttttctttttcctgggagatggtgttcaaactggtaggaacacacaccaagcgtaactttcgttgattctgacacatttatggtcatcatggcgctcaaactgtcttcaagcctctcctcttttccttccagatcatgcatgccccgcggtccagggacaggttcacagcgccgtccttcatccagagggatcgcttcagccggcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggca

SEQ ID NO: 12571 - DNA, 3007 bp, Homo sapiens
cgagctcggtaccaggggttgttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggca

SEQ ID NO: 12572 - DNA, 2869 bp, Homo sapiens
gctgattcttgatgtaccccggtcatcttgctacacgagacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggca

SEQ ID NO: 12573 - DNA, 1633 bp, Homo sapiens
acgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaaggtacatttcccaagaactgctatggatgatgcatgctctttcgggtttgctgtggttcttcttggagtttggtctgaggacagagctgagaagaggagaagctctttctcaagaagtttctttctacctaagaggggtctgtcaactcagaacatttccgggtgggactccctttaggaagatgcatgtcaggctttttcatcttctttcaagcctggaattagtttgttcctgttggaggtgttatgcatgagtacacagtttgttgctttggagttttgtttttttcaaatgtctgtatatgaggctgagacctcccctggaaattctgctacttgttaataattcctttttcttcaccctcatgagctgaaaactgcattttaaagaaaaggtatttctcaggatgtggctggttcattgaacactttcttaggtcatccatgtagtgacaggagctattaggaaggagaactgtgactctgagagatagagagccaaagaaagtgagagacagacagactggctgtgggatgagagcctcagaagccaccactctcccctgtggaaatgaaggttccattccatgtgcagctgtgttttttttctgatgcactttcctaaattaataatgtggaggtggaggtgagggtggattttaaatgaatcctatagggggaattatggcttatgtat

SEQ ID NO: 12574 - DNA, 765 bp, Homo sapiens
cagctgtcggaaggtggcgagcctgaggcgaacaatggcggagctgggcgaagccgatgaagcggagttgcagcgcctggtggccgccgagcagcagaaggcgcagtttactgcacaggccacgtgcccgtagaaaagatactcatccactgtgggttttggtttcgccgtcaccccactgcctcactggattgtgaggatcatatgcgacaatgtatttgaaaacgactagaacattatcggaggaaggtggactctgaagtagtcgctgtagactatggatgtagaacaagggtttggagcccttcggacatggttctaacgcggcctgacttcttgctggctacatgaccttggactacataatcacgcctcttaaatgggaggtgatgacagctatccttgaggaccttagagagaactgatttcttagtacccagcctcacaaatagtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgtt

SEQ ID NO: 12575 - DNA, 1172 bp, Homo sapiens
cagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggcaaaaaaaaaaaaaaaaaggcaagatgtgtattccttgcgaaagaacaagcctgctaatttgggaggaagggaaggtcaggacccaaatagagccaatttcctggagatggcctgttctactggcacattttcctgagtctgtgcttaaaacctttcaggtactttcagggcacagaaacaatgcatgctaaaaaatatatggccaaagctccttccaacaaagatttaacttgctccaggaacaaaataattgctttaggttaagaggtagtaattagagactattctccctttagacccccactaatcccaaaaataaaaatacacaccatggaacactgacaattgagtaccaaagtattaaaatttaaaataaatatcccaaaaggtagcacctgctcatagtt

SEQ ID NO: 12576 - DNA, 432 bp, Homo sapiens
cagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgtt

SEQ ID NO: 12577 - DNA, 1505 bp, Homo sapiens
cagctgtcggaaggtggcgagcctgaggcgaacaatggcggagctgggcgaagccgatgaagcggagttgcagcgcctggtggccgccgagcagcagaaggcgcagtttactgcacaggccacgtgcccgtagaaaagatactcatccactgtgggttttggtttcgccgtcaccccactgcctcactggattgtgaggatcatatgcgacaatgtatttgaaaacgactagaacattatcggaggaaggtggactctgaagtagtcgctgtagactatggatgtagaacaagggtttggagcccttcggacatggttctaacgcggcctgacttcttgctggctacatgaccttggactacataatcacgcctcttaaatgggaggtgatgacagctatccttgaggaccttagagagaactgatttcttagtacccagcctcacaaatagtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggcaaaaaaaaaaaaaaaaaggcaagatgtgtattccttgcgaaagaacaagcctgctaatttgggaggaagggaaggtcaggacccaaatagagccaatttcctggagatggcctgttctactggcacattttcctgagtctgtgcttaaaacctttcaggtactttcagggcacagaaacaatgcatgctaaaaaatatatggccaaagctccttccaacaaagatttaacttgctccaggaacaaaataattgctttaggttaagaggtagtaattagagactattctccctttagacccccactaatcccaaaaataaaaatacacaccatggaacactgacaattgagtaccaaagtattaaaatttaaaataaatatcccaaaaggtagcacctgctcatagtt

SEQ ID NO: 12578 - DNA, 606 bp, Homo sapiens
agcttcgggctaccagaagaatgattggaggatgctgaagaaaacaagaaagaagacaaggataagaatgagggttatggcagttcctgacagagtgggtactgtgaacaaacaccagaggtagaacaagctgtgttatgtgtttgtcaagaattacaagcaatctggtgttgctggtgtatcataggcgaggcaggaagtggtaagaattgagactaccattttaagttcttaggaacaggaggaaggagtcgtgtgttccgtgtttgggagcttgaactgtaatgtgtaagcaatgagacaccattaaagagttttaaggggggccgggcacagtggctcacgcctgtaatcccagcactttgggaggctgaggcgggcggatcacctgaggtcaggagttcaagaccagcctggccaacttggcgaaaccctgtctctactaaaaatagaaaaattagccggacgtggtgacaggcacctgtattcccagctactctggagtctggggcaggagaatcgctcaaacccaggaggtggaagttgcagtaagctgagatcacaccactgtactccagcctgggcgacagagcgagactctatctc

SEQ ID NO: 12579 - DNA, 972 bp, Homo sapiens
ggcacaaggtcatgcttaaaaagaccccttgttctactgcatcccagctccccaccatggggcctcacaggccctggtgaccaagcacatcagacctggttcttgctcagtcctgggagccacagaacccagcacgtactttacccccaagaccagactccagcttggcttttgtcctcctctccaggattggtgacctcctaggtcgtgaagctgtgatgagcaaagacacactcctctccattctcccaacttcaggtccctttgacagtgtcagcaggcatttaaatagcagaccacccacagcagggctggtagatgcagtgaactcaggaagatgcctgcatagactctagtgttaaagacagaatccttacaaggaacccccatagttacctaactgctgtctccagtggtcatagaagtgtgataacccactaatcatcattctctgtctctctgtctttctcatacacacttacacacacatacacacaaccttgttgcttaattttcagagagtctactttcagaaaagccttcaggaatacatcatgtacaaaactgagaaattacctgaagtatctttaaatttagtaaaaagttgcattgttttttgaacatcacacttgaaaagtacatgaatacaaacatacttaggaaaaaaagctttaattaatttaaaaaggagaacaatgctatatgctgtatcccacctttctctgaatgttacattttctcccctatcccaggctgcatctaagaaaactcaaagggaatatgctatctatcttttccgagcaatgaaagctctgggttttttccttgcttttcagggcacaatacttctctttcttcctggttagacaggataagttctgagtcccctggtatcatcagcttacttcttctctgttaaatattcacaaaaaatcactaactttcatgcctcagcaaacctccactgcctaa

SEQ ID NO: 12580 - DNA, 1440 bp, Homo sapiens
caggtgctgacactagaacaggactccactccgacattccgggtacacagaacttcccagtgggaagagctagccacacaggtggcagaagcttggaaaacaacccatcccagccctacgctctctgaatgtgaccttgggtgcaagctgggtttgtatgaacttactggcatttctaacaagacagtgtgtacgggagcatttcaactgcaaagaccactgaactggacactgtcggcgtgacagtatcaagtaaccattaggcagagcaaaacgtaaataaaagtactctgtgatggggtagtcagtcagatgtgtggtggggacactaaaaatctctcatcacctttttagtcaaaagaacagttgttttggtttggctcttctgttttaaaatatcagaacaataataatttcccacagacaaaatcctcaatcctcaccatcctttctatttcctatattcatcataaacttcatgcttgatgttgaaattgttttctgaaaatagagaatacaaagaggagattttaaaatgtcagtggcagccccacactcctttttaatcttatttcctgatatcttgagtttacttggacgtagagttttccttgactatggttatttctggtagtagcagctccagattaggcaatggttttcttcagagatagcttagagtgagccccagaacaaggtcaatgcgaagattgcttgtgtctgcgtgtccagggcacagtgatcctcatcactagccggggggctccgtgaggatctgctcctggtcgtttctgttctgtatcttctctgcagcccttactgaagccgttaccaactggcacaattcaattcctactgtacccatcatgcacagatggctgaagtattgagaacgctccagtgaccgggaggcaatagtctgtctctctgtctttctcatacacacttacacacacatacacacaaccttgttgcttaattttcagagagtctactttcagaaaagccttcaggaatacatcatgtacaaaactgagaaattacctgaagtatctttaaatttagtaaaaagttgcattgttttttgaacatcacacttgaaaagtacatgaatacaaacatacttaggaaaaaaagctttaattaatttaaaaaggagaacaatgctatatgctgtatcccacctttctctgaatgttacattttctcccctatcccaggctgcatctaagaaaactcaaagggaatatgctatctatcttttccgagcaatgaaagctctgggttttttccttgcttttcagggcacaatacttctctttcttcctggttagacaggataagttctgagtcccctggtatcatcagcttacttcttctctgttaaatattcacaaaaaatcactaactttcatgcctcagcaaacctccactgcctaa

SEQ ID NO: 12581 - DNA, 988 bp, Homo sapiens
caggtgctgacactagaacaggactccactccgacattccgggtacacagaacttcccagtgggaagagctagccacacaggtggcagaagcttggaaaacaacccatcccagccctacgctctctgaatgtgaccttgggtgcaagctgggtttgtatgaacttactggcatttctaacaagacagtgtgtacgggagcatttcaactgcaaagaccactgaactggacactgtcggcgtgacagtatcaagtaaccattaggcagagcaaaacgtaaataaaagtactctgtgatggggtagtcagtcagatgtgtggtggggacactaaaaatctctcatcacctttttagtcaaaagaacagttgttttggtttggctcttctgttttaaaatatcagaacaataataatttcccacagacaaaatcctcaatcctcaccatcctttctatttcctatattcatcataaacttcatgcttgatgttgaaattgttttctgaaaatagagaatacaaagaggagattttaaaatgtcagtggcagccccacactcctttttaatcttatttcctgatatcttgagtttacttggacgtagagttttccttgactatggttatttctggtagtagcagctccagattaggcaatggttttcttcagagatagcttagagtgagccccagaacaaggtcaatgcgaagattgcttgtgtctgcgtgtccagggcacagtgatcctcatcactagccggggggctccgtgaggatctgctcctggtcgtttctgttctgtatcttctctgcagcccttactgaagccgttaccaactggcacaattcaattcctactgtacccatcatgcacagatggctgaagtattgagaacgctccagtgaccgggaggcaatagtctgtccacatctaagaacacacttggaataaccttagagaagagagagagagagagaatgcatggttag

SEQ ID NO: 12582 - DNA, 431 bp, Homo sapiens
tgctaattctgttctggggagcatcttgtattgtcactgttttgtactaaatcttcaaatattgtctactgtgtaaggcagaaaaatttcttatcatgcaaaaaccattttgtttccagggtaacaagtaactaagtgcatgcacaacttgttttcccttgtaacattcatgatctcatttacaactctgattttaaaacaaaaaaatctttacaacaagctatatagggacataccagatgttgcagtgattttagctatcaacaaactgttaaccatgtacaatatttaaaataggcttattttgatgtatcgcctattatacaaacacacaaaacatttttggaggcctcagttatgagtgacagagctttctgtgtataatttgtctaaataatttgtctaataaaaatgttttctaaacttgctct

SEQ ID NO: 12583 - DNA, 281 bp, Homo sapiens
atttagcactggactgccaactttaaccctttctttaacattcagcagagggtcagctcaggagctcggagaagctgtccattatagggccatcattttgtcatctccagttatacctgatgttggtttaggctagaattcatcccagccaattagtcagttgagttcagtaaatctgtattttgctgcagctgtggccctagctctgtgctggatactgggaagactcatagtcttggtcccaaaggagcttaaaagccttgccaggaaggatgccataa

SEQ ID NO: 12584 - DNA, 1681 bp, Homo sapiens
tccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattagtttttactaaaacatttatcagaaattttaatactctgcataaccagtattagcattagaaattagccacttttaaaatgagaaaactgtgtcactcttcaatttttttataagccattgaggaaaacattaactcctggatttcagcttcacttttaacctgcagactaaatttctttctcaattatgtcagacacacccaagtcaatcccaacccccttgttaccttgggaagaccgtgctgaaaaaggagatcttccacctaaacagtgttctcttatttgaagcaaatctttttgagaatttgtttacttgatttctttccacaataaactgacagagaacgctactaatgatttttttttttttttggagacggagttttgttcttgttgcccaggctgcagtgcaagggcacaatcttggctcactgcaacctctgcctcacaggttcaagtggttctcctgcctcagcctcttgagtagctgggattacaggcatgcgccaccatgcccggctaatttggtattttcagtagagacggagttgcaccatgttggccaggctggtcttgaattcctgacctcaggtgatccacctgcttcggcctcccaaagtgctaggattacaggtgtgagccaccacgcctggctaattttgtattttaagtagagatggggtttctccaaaggctggtcttgaactcccgacctcaggtgatccgcccaccttggcctcccgaagtgctgggattacaggcgtgagccaccgtgcccggcctgatgtttttgaatgattatgaaaatgggtatacagcattaaaaccttagactgattttaaatatattaatttcttttaaactcaatataatgttaatattactgtagcacttactagcatttctgaaggttggtcttgagataagattgaaaatgacagttgttgattttctgaggtaatatacccaaataaaatatatgtatgtgtacatgaatctaaactgtcttcttctgttcctcattttgctttacttaaataatctttcatattttttaagtgttttgcccatgtgcttgggtagccttgaagtcaccagaataactaggactcaaattcagaccaaaccaggactagctttttgtgccatgagttagccatggtcctggacccagcaaaaagaatgattatgatggtcagagtaagatgagcaattgcaacataatattctctaatattgtatactgtaaatttattcagctgccctcgtttactcacagtttgcttatttgccaccataagaaatggtacaataaaaattcatgtaatcaccccttagatttcagttg

SEQ ID NO: 12585 - DNA, 1640 bp, Homo sapiens
tccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattagtttttactaaaacatttatcagaaattttaatactctgcataaccagtattagcattagaaattagccacttttaaaatgagaaaactgtgtcactcttcaatttttttataagccattgaggaaaacattaactcctggatttcagcttcacttttaacctgcagactaaatttctttctcaattatgtcagacacacccaagtcaatcccaacccccttgttaccttgggaagaccgtgctgaaaaaggagatcttccacctaaacagtgttctcttatttgaagcaaatctttttgagaatttgtttacttgatttctttccacaataaactgacagagaacgctactaatgatttttttttttttttggagacggagttttgttcttgttgcccaggctgcagtgcaagggcacaatcttggctcactgcaacctctgcctcacaggttcaagtggttctcctgcctcagcctcttgagtagctgggattacaggcatgcgccaccatgcccggctaatttggtattttcagtagagacggagttgcaccatgttggccaggctggtcttgaattcctgacctcaggtgatccacctgcttcggcctcccaaagtgctaggattacaggtgtgagccaccacgcctggctaattttgtattttaagtagagatggggtttctccaaaggctggtcttgaactcccgacctcaggtgatccgcccaccttggcctcccgaagtgctgggattacaggcgtgagccaccgtgcccggcctgatgtttttgaatgattatgaaaatgggtatacagcattaaaaccttagactgattttaaatatattaatttcttttaaactcaatataatgttaatattactgtagcacttactagcatttctgaaggttggtcttgagataagattgaaaatgacagttgttgattttctgaggtaatatacccaaataaaatatatgtatgtgtacatgaatctaaactgtcttcttctgttcctcattttgctttacttaaataatctttcatattttttaagtgttttgcccatgtgcttgggtagccttgaagtcaccagaataactaggactcaaattcagaccaaaccaggactagctttttgtgccatgagttagccatggtcctggacccagcaaaaagaatgattatgatggcaaataagcaaactgtgagtaaacgagggcagctgaataaatttacagtatacaatattagagaatattatgttgcaattgctcatcttactctgaccatcataatgtcgac

SEQ ID NO: 12586 - DNA, 764 bp, Homo sapiens
gaatgggaatgcctgggtttgcgtacccctactcatctgatttcttcatctggtccacagaccttaggagtgctttagtgtatgtggtaggcctgggaattcagggattagagaatcagtctctttctctgaagagttccaagtattgggcgttagataagcaaacaattaaaatccagtgtgcttagtgaatggtagaggatactattggatactaggagaacactgaggaggggcttccaagtcctcttggagtggtcacagaataatttctgcaggaagcaacattgggtagaaatttaaaaacaacaataacacttattgtaactttttaatctgtacaaagattccattcttagaaggcttggaaaatatatcaatgtataaaaaatgatttataaatacatgagccaaagataaacattttcatatttctagtctttttatgcatatgtaacaaatatttgcataattgtgatcatactgattataaaattaagtacagtcattcactgcataacagtgtttgagccaacgatggatcatgtattcagcagtggttccataagattataatagagctaaaaaaattccagttgcctagtgaccttgtagctgtctagcgcaatactttactcatgtgtttgtggtgatgctggtgtaaacaaactactgtgctgccagttgtataaaaatatagcacataccaattatgtgtagtatgcaatacttgataatggtaataaatgactgttactgcatta

SEQ ID NO: 12587 - DNA, 540 bp, Homo sapiens
ttccggggttgctggaaacatgtctgcccaaggtcatagcacagtcagagaaaggctggcacatctgggccagccacaagcaccaaaaataaaaagggaagtgggatgtagaggaagaaagttaagctggaaacatttttttcataaaaatgctaatgctgtgaggccacccaggacactaatagaaggagatggaggtgaaataaagaaacgagtttcagctgtttttaggaaagaaatactaaagagaaataattattagatctaaagatgcaataaccagaaagccccctcttgtgggaagagaaggcagccttttctgaagaattgaagtggtcaagagaggatattcagtgtaattctgggagagaaaggaggaacatgaggattcagagatgtgacataagagtcttagagaacttcaaagtgaaaaagcagaagtgagaactgactcggggaaaggaattgataaataagcacgcttaaacaggtgtggtcccaaggagtccatggaaggccagcttactttaaaaaaaaaaa

SEQ ID NO: 12588 - DNA, 444 bp, Homo sapiens
aaaggaatggttaggcttggcagctgggccactgaaactgtttggtatcagtattgcggtggagctgaggactgcaggggaatgcgtgctcccgtcctggtgcagaaaaaataaaagcagccagacagtagctagatggtgttttgtaacttttgggtttggccctgatagtgaaccactgaatgaagatggatgaagggaatgctactaatgggggccccaaagaaaacaaaaatcagacgtgtgctcttcctgttttctgtctttcattctttccctgtactttgtgctcagtactgtgttttgtcattgtgttatgtcgtagttctcagttcacatctgctgtacagtgaccaagctgtgaatcatgtccactcgggaaagaggttgattctgtttaactgacaactgttgcttttgcagatggtcacacggaaaaggaaa

SEQ ID NO: 12589 - DNA, 1161 bp, Homo sapiens
taacatgtgtacttcaaattgtagtagtgactggaaatttaggattctgttgtttcataacacttaaatctgcagcagattttcaggaaaatggtcaagattcacagataattccttccttattccttacagattttacaattgtatggttatttctgaatttggttaatttgtttataagtgtagtggacatttaacagaacagatgcacccgattatctgattagaaatgtgtttcaacacacgggtccctttgcgtgtttccaatctctgttttcggatctgggattctccacctgttacatcgttcactggaactttcctacaaaatacagcctcgctgagaggcgcatcgtggaaaaatgaagcagcctgaagaaactctaatattgggaccgagtggagagatggaagagcatcatcagagtggtgccgccgcacatgcgggaggcgtcccaggcagcattgctctttgtacatgagacaggataccactgtcttttatgcattagactggtaaccagataaaataaccttgtaaaacagatcttttatgtaagaaaaatacaactctcacctcgcaaacattcctgtctgttgcggatgaacctagcagcaggagaggagccagggtcagtccacttggcctgaaagttaacgtcatatattcagatgtcaaggggtttctgtgcatgcttttgaagtattgtgtttgggcttttacaacatgtgcctcactgtttcgcatctacagagagagtgccgctgagagaggagcctgagtggatccgtgcccagatctgcattctctgtcctcaccacttctccctgctggttgatataaatgtggggataacgtcgagcacaaaggagtcaaaaattgatcagggctgggtgtggtggctcacgcctaaaatcctagcactctgggaggccgaggcaggaggactgcccaaggccaggagttaacatagcaggaccctgtctctacaaaaaataaaaaaaatcggctgggcatggtggtgtgcacttgtggtctcagctgtttgagaggctgaggcaggaggatctcttgagcccaggagtttgagcatgcagtgagctgtgatcgtgccactgcacttcatcccaggcgatggagtgagaccccatctcttattt

SEQ ID NO: 12590 - DNA, 501 bp, Homo sapiens
agtgtgggtcattcctgatgtgtcaggtctgataacaacatgaccagtgaataagaagcctttcagcttttctaggggaaaagactctgtagtattgactagtgaggaagaaaaactaaaacctgtgagtatgatgagtagagtatttgttacgtggatttctgagctgtaaagtctactttgttctttatagaaaaataaacacagcctaagataatttgacatctagttttcaaggaagccattaagaagctgtattttggcacatttatttaatttttaattgtgtgttcttttgctttatatatttatatgcatatatgaaccttttgaaatggttttatattttaaaaaagaatatgcattgcagagaagcctgttaaaaactcaatttttcaatgtaaatgtgaaggttagattgtctctcctgttagattgcaattccagaatagagctctacttcctgttgcagtatccttataaataaaataccttttttaa

SEQ ID NO: 12591 - DNA, 554 bp, Homo sapiens
ttttggggggataaggagggagaagttgtggtttgctgatatgatctatctgtcaggagaggggtaagtatgactaccggccctagtgagagactacctacctgggtgagagcccaccttctgccttctatatgcatgtaactaaaggcaaatgacctgtcgaagcctcttctctgtcaaatgggaataagcatggcaccagcctcttagatcattgtgaggattagatagctaaaatgtttaaagtgctagcacagaagcatagcaaggaataaatacatgtgagcttttattattatatcctgcagtttgctgcctaaagccttgaagagctctgctctttttttttgaattaaatgtcctaaagaaatctctctttggcatatatgagaatatctgccaagtccatatttggcttttcaaagataaaatgtttatgcaacaaagaagttcatacacaggcttcattactaaaaattttagtcaactaaatattagtttcatgtcgttcttataaattgctcttgttttcctgagtttcctttcttatttgt

SEQ ID NO: 12592 - DNA, 348 bp, Homo sapiens
ccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctt

SEQ ID NO: 12593 - DNA, 545 bp, Homo sapiens
tgttttgtttttgagacagagtcttactctgttgccaggctggagtgcagtggctcaatctccgctcactgcaacctccacctcccgagttcaagcaattctcctgcctcagcctcctgagtagctgggactacaggcatgtgccaccaccatgcccagctaatttttgtatttttagtagagacggggtttcaccatgttggccaggatggtctcaatctcttgaccttgtgatccgcccacctcagcctcccaaagtgctgggattacaggcataagccatgcgcccgaccagtattactcacttttataaaatgtcacatggtttaatcactgggagacaaggagacgacacaacttcatgctttgctgtctgtgtatgaactgagtacagatgcgtactgaccagtcattgccttcgaagaagtgacatgatcagtcacagatcatgatgtgcatgtgttatttacttagtgatttatgaactgaagagctagcagggaaatttgtgcttcatgcaattacaggtaatatatcaaggtaac

SEQ ID NO: 12594 - DNA, 409 bp, Homo sapiens
gttgcctttcgaaagaaaacatgattggaatgtgaagaaaaagatactaaaaacaagacaaaaaagtaacactaagtttaaaattttgaaaactctgaattattcaaatttgaattttattcttatttgttaattcttgaaacataacgcttatttcattgaataattgacactgttgttgctactcatgcccacactgaagctcctagacttgtttccttcaagtgaatgtatttagtgtccttaaaaagtaatcctctattttaaaactcatttgctttcagaagataatccttcagaaaattacattgggtttgtattgctctgagaagaatagtggcatattctgtctagttatataaaatctttctgttgtagcttttggttaagcacatgccaaacattttct

SEQ ID NO: 12595 - DNA, 368 bp, Homo sapiens
aagaaaataggtgactttttcactatgtgcttaggtgactgcagatgcccggcaatgttccctcccaggccctcctgggtgagcccgcctcccaggcaggggtcagcatggccggggtccctctgtctgagcccaggattcgtgcaacaccaggaagacaacagttgaaggttccttagtgagctaagggaagtatacacaaacttactacataaacattagaaagtgctgtccgtaaaaaacacgtcttcacagagccaacaagcagagaaatagctgcccagtgttaggaagtgcatcatgatccagaggttcagcccgtgtgcagcgcacagacctgaggccccagagagaccgaggacgcagac

SEQ ID NO: 12596 - DNA, 437 bp, Homo sapiens
gttttctcatgtataagctaaatcatcctttagccttctttctttcaagctaaatgactctggccctttaatctttcctcgtaggacctgttcaccatgccttttatgttctttcccctctttctctctctctctctctctctctctctctctctctttctaagagaaggggtctccactaggagcaatggctcacacctgtaatcccagcactttgggaggcttaagagggcagattgcttaagccaaggagtttgagaccagcctgggcaacatagaaagaccctgttttcaaaaattagctgggcatggtagtgcatgcctgtggtcccagctattcaggagactgaggtggtgaagcttgtgagccaagattgcactactgcactccagctgggcaacaaagcaagactctgtatcaaaaaaaaaaaaaaaaa

SEQ ID NO: 12597 - DNA, 1270 bp, Homo sapiens
aaaaagaaaaggtttgtttttagttctctgcctctgcaagtctttgtgatcacatttgttaaattgaatctgagattcaaatatttcatttaatattttctgggttttgataatgggatattctgtaagataaagcaagtaatcctagagtgatttactttatgtttagccatccaccattttcctatttctctactcctcccattctccatttttaaaaggaaattaacaaatgtcttcctttatccctgcctcagataatttttccctgaactcatcttgtcagcagaaacatttaatgtgaaataattctgtatttctgagacaagatcaacacagtagttctttacattgagctgaggtgaatgtatacttaaaaatactctattttctttttatatgaacttaaaatttttaaaatcatatatgggactccccaatgtgaaaatattagtctggacattctcttgccatcaggtgctatttctaccttagctgtgagttagactaaatccaaatttcgtatcattcatctttttataatatttaacttccctagaatcaccccatttcatgtctttaaccccaacttccaacaacttttctgcttttattttcaaatgtcaaattgtatttttgtgttttattttctcattgaagtgtaaaagtatcacatatatgaaggaatggctggtttagacatttactttggcatagtaaagattgatattgataccacccaccatcctttcctctagccccagaaagaaaagtttgacaactcaaaaacgattaaattatcttatcttgttatttaatagaacaatggaagctgtttcgtcaaaattaaaatactttaccaaaaaaatacttttttgtattttaatctgatagtgaatttggggattatttatgtaaatgtatcataattaatagtaattatgagttatttcactctctgtaatttgtgatacccaagattcatatttatttaatgtgaggtgttttttgaggcttttttgttttatcttgttttcttaactttttacagtgttgttagattatcgcggtcatctcggcatgtgggatcgctcctcctgtaggatcagctgttctctcttagagtcagggacaagggagggttttgctacatggtcgatagttgggataataccgccattattctggaactatctgaaattgctggttttattggtcaaaaatgatcagatgctagcaatttcataatagatatattcaagaaggaacc

SEQ ID NO: 12598 - DNA, 584 bp, Homo sapiens
aagagccaccctctggcctgtgagggcctgctttaaggctacgttaaggacaggaaagtcaatgaaaaatgcatgaagacgcacataggcttctcttagaagaccggcatgaggagcctcttccacgggcatagggacattctagaattagcaagcagcacaaattgtttttctttttcttttttttttttgagatggagtttcactcttgttgcccaggctgctggagtgcagtggcatgatctcggctcaccaaaacctcccgcttcctgggttcaagagattctccctacctcagcctcccagagtagctgggattacaggcatgcgccaccgcacctggctaattttttgtatttttggtagagacggggtttctccatgttggtctccaactcccaacctcaagtgatccgcccgcctcggcctcctaaagtgctgggattacaggtgtgagccactgcgcccggccgcacaaactctttttctagcattgagcattcagccactttccacacaaataactgtttttcagcccccaagagcattttgcaggccatccatgacatccagaaaagttttgc

SEQ ID NO: 12599 - DNA, 498 bp, Homo sapiens
tgcggccaccatgtaagtcggacctgcccttctgccatgattgtaagtttcctgaaggacttccccctctgccatgattgtaagtttcctgaggcctccccagccatgtgaaactgagtcagttaaacctctttcctttaaaaattacccaacctcaggtatttctttatcagtgtgaaaacagactgctatactttctgataatcatgcttaagcaattggggaattcagactagctgggatcaaactatggccccacccttagcagtcatgtgaccttggggaggttacttaccttctccgtctcaacaacttctgtaaaatctgtaacatgagattgtttctgagggttaaatgagcatagcacagtggggacactgtcaggcacacactacttgccagatgtcgagtattcctctttattgaaataggactgtggtaagccactttatggctctcgattgtgtatgagaaaatcatgcttagtgccttgttagt

SEQ ID NO: 12600 - DNA, 1412 bp, Homo sapiens
ccttttccgttgtcccttcgcgccccaaaccacatcctggagcgcactctccagcgtggctggcagcggggacggtgcgccggggcgcaggcccaagagtcgcgtgcgcggccccttgcaccatccccccgggcccacccccgggccgcgctgattgggcaggtagggactctgcccagcggaaagttttgggtgccgggaggaagtctaacctttgggagactccaagacagcagctccgaggtcggcgggggtctgggtggccatggaggagccccctgtgcgagaagaggaagaggaggagggagaggaggacgaggagagggacgaggttgggcccgagggggcgctgggcaagagccccttccagctgaccgccgaggacgtgtatgacatctcctacctgttgggccgcgagcttatggccctgggcagcgacccccgggtgacgcagctgcagttcaaagtcgtccgcgtcctggagatgctggaggcgctggtgaatgagggcagcctggcgctggaggagctgaagatggagagggaccacctcaggaaggaggtggaggggctgcggagacagagccctccggccagcggggaggtgaacctgggcccaaacaaaatggtggttgacctgacagatcccaaccgaccccgcttcactctgcaggagctaagggatgtgctgcaggaacgcaacaaactcaagtcgcagctcctggtggtgcaggaagagctgcagtgctacaagagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggttctcttggcatcactttctccctggctgcagaactagacacccttgaagatttggcctgggccagtgagactgaaatcaagaaaaacagaagggatgtgcagggtgggggggtccacttcctgctcccatgtcaacccccagggcctccagcgtgcagacgcgtgtcctactcatctgctcccacggatgaccctggtcttcaatggttagcagaagggagaaaagaaagcaggaaaatgtgctattgagattccagtggtgacttcactgatatttagtgaatatttgatttagccaacatgcctttctttatgtgattttgtattaaagtaaaatgatttttatactttcaaaaactta

SEQ ID NO: 12601 - DNA, 924 bp, Homo sapiens
ccttttccgttgtcccttcgcgccccaaaccacatcctggagcgcactctccagcgtggctggcagcggggacggtgcgccggggcgcaggcccaagagtcgcgtgcgcggccccttgcaccatccccccgggcccacccccgggccgcgctgattgggcaggtagggactctgcccagcggaaagttttgggtgccgggaggaagtctaacctttgggagactccaagacagcagctccgaggtcggcgggggtctgggtggccatggaggagccccctgtgcgagaagaggaagaggaggagggagaggaggacgaggagagggacgaggttgggcccgagggggcgctgggcaagagccccttccagctgaccgccgaggacgtgtatgacatctcctacctgttgggccgcgagcttatggccctgggcagcgacccccgggtgacgcagctgcagttcaaagtcgtccgcgtcctggagatgctggaggcgctggtgaatgagggcagcctggcgctggaggagctgaagatggagagggaccacctcaggaaggaggtggaggggctgcggagacagagccctccggccagcggggaggtgaacctgggcccaaacaaaatggtggttgacctgacagatcccaaccgaccccgcttcactctgcaggagctaagggatgtgctgcaggaacgcaacaaactcaagtcgcagctcctggtggtgcaggaagagctgcagtgctacaagagctgatttcatcaagagaaggctaaaaaaaaaaaaaaatactaaaaaaatttttgggggggttgggccttaaaaagtttttaacacactttttgggggggggccattggtattgacatgtctaaggggtcctaagagaaaccggggcggactagggtggttttccataa

SEQ ID NO: 12602 - DNA, 1233 bp, Homo sapiens
gagactccatgagagttggctccggaggctcggacgtgagggttctgtggatggtcggatggtgagaggctcctctgtagcggaagataagaggaagaaggaagtgaagggatgaggattgatcgagcgagtagggacagaaggtctgggggccgaggggagcgttgggcaaagagtccagtttgagagttgatcgggcggaagacgtgtatgacatctcctacctgttgggccgcgagcttatggccctgggcagcgacccccgggtgacgcagctgcagttcaaagtcgtccgcgtcctggagatgctggaggcgctggtgaatgagggcagcctggcgctggaggagctgaagatggagagggaccacctcaggaaggaggtggaggggctgcggagacagagccctccggccagcggggaggtgaacctgggcccaaacaaaatggtggttgacctgacagatcccaaccgaccccgcttcactctgcaggagctaagggatgtgctgcaggaacgcaacaaactcaagtcgcagctcctggtggtgcaggaagagctgcagtgctacaagagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggttctcttggcatcactttctccctggctgcagaactagacacccttgaagatttggcctgggccagtgagactgaaatcaagaaaaacagaagggatgtgcagggtgggggggtccacttcctgctcccatgtcaacccccagggcctccagcgtgcagacgcgtgtcctactcatctgctcccacggatgaccctggtcttcaatggttagcagaagggagaaaagaaagcaggaaaatgtgctattgagattccagtggtgacttcactgatatttagtgaatatttgatttagccaacatgcctttctttatgtgattttgtattaaagtaaaatgatttttatactttcaaaaactta

SEQ ID NO: 12603 - DNA, 838 bp, Homo sapiens
aggagttcaaaaccagcgtggccaacatggtgaaaccccgtctctactgaaaatacaaaaaaattagccaagtgtggtggtgggcacctgtaatcccagctactcgggaggctgaggcaggagaatcgcttgagccagagaggtaggggctgcggagacagagccctccggccagcggggagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggttctcttggcatcactttctccctggctgcagaactagacacccttgaagatttggcctgggccagtgagactgaaatcaagaaaaacagaagggatgtgcagggtgggggggtccacttcctgctcccatgtcaacccccagggcctccagcgtgcagacgcgtgtcctactcatctgctcccacggatgaccctggtcttcaatggttagcagaagggagaaaagaaagcaggaaaatgtgctattgagattccagtggtgacttcactgatatttagtgaatatttgatttagccaacatgcctttctttatgtgattttgtattaaagtaaaatgatttttatactttcaaaaactta

SEQ ID NO: 12604 - DNA, 1457 bp, Homo sapiens
gttttatttttttagttattcaatagtaggatacaaacatcgcatagcaacgagtaatgtgattatttgtgctggcatcaggcttggtgaatttatagcatgatatagatagatacaggccttcttatctgaaagcgtaatattggagacaggcatatgtggtggtcatagacagtggtatattatttcatttacttttcagcaattccttgaggtcagtactttgttgtctccattttgtagagaagaaaattgggccgtagggaggtcaaataactggccagaggtcacacactcagtggaagactcagagtctgaaccctggtcagcctgacgttagagccctccgatgggttcagccactgggctatatctgcctctttgtcattctttcacaacagggagggaaagacatcttattcctttaattctttaacactttcttattcctgtaattctttaacaagactgggaaagacatcttattccaggtgagcagaggtgtgggctgcttgggctgtttcttttctctgatgaggtcttgtgaagacggcagaaagccaagcaagtgtcagacaaggtgtgtaaagctctttggcagctctgtgattggagggaacccaggaacagaaaagtttaaggaagtcagagatagagatgttagtaaatgtaataaaatcacttggctgtggaaggtcatttttttcttttaattctagattttttttttcatttttaaactgccctccaccctaaatagcttgtgattgttatattcccttaaaattttcaaatattatttacaagagagctgttttacaggagagctgttttctccatatagctgatgtacagacagcacagccctcttcagatttagtaatgagaccaagaagtctttaaatattggtgaatggcatttgtccatttgaggtgaatcatgaataacttgaacaaaaataaaaaaaaataagcaagactatcatatttgaataatgaggtgctctttttttcccaactgccaaaactttttaatctttgtcaacgattgttctgtcctccgtcttatttaggttgcatctgtgcgactctgagctcaggagccctgacaagcggcatatgaattctgtattcattagtgatcttgatccaaatgcctctgtccctgccacgggggctcaggtgtggaagctgctggctaatcccaccagctgacattcagaggtttaatgactccataggaaggtgaccactcgctgggaggtttgctggcggaacccacacagcagacagtggagatcaaggaagactatccgtgtttagccgaagcaccttcctgtgcaacttgaaccctgttggcatcaaacacagagttttaagtaaatgcaaaattaaaccaaaaaaacctcgaccttcgataactattataaacaatgattttcttatctgttttgatg

SEQ ID NO: 12605 - DNA, 388 bp, Homo sapiens
aaattcagtaaggcattcacagattatcaccacctctgtaagaagtatatagagacacatgtttgaaatatgcataatgagatggagaacagtgtccctctcagttgttgtgttgggctagctcagagaattcagtttctgctgtcatcacagctgggaatgagaaagggagggggctctggttggtctccctctgcctctggagcacacatgcaggacaagaggctgctgtaggagcagctctgaaagctgagttctcgggtccttgtgaaggagggaagcttgcctgccttggagcgtgaaaaagtcttgctggacagaagtctcatggtttaaaaatgggaagggagaggattgagatcacactagaatgcacagaaaattctta

SEQ ID NO: 12606 - DNA, 295 bp, Homo sapiens
aacaatgagtcagaggactgggctctgatcttgagaaagctgattttctctatgaccttcaattagttatataatctttttgtctgtgaatcttttatctaatctgtgatatatggtaactacttttttgtttgttggttgaggactataggaaatacaagatgttattttttctcatatgttgggaagacccattctttctgcatttcttctaagggacctctttctccttaagcacgtggacttcactggcaaacaaaggatgtatttaacctgatgaggaaagtcaattctg

SEQ ID NO: 12607 - DNA, 426 bp, Homo sapiens
acctcaccttggcttataacatgacttatacagaagttctaagcagccctcataaaaattaactttggagtattacctatttaaggactttatgaaacaaatttataacaaatttgaacaaggaatttattacgaattcagaaatctctgtatgagcccttaattattgcttgattaaaatcctgacgaatcacttaggaatacattgttaacagttttctatgttgtctaccaaagtggaagttatctggcaaacagtttacgttgctagctaacagggaagaaaagtttctaatacgtcaccatagctgggctcattggctcgtgcctgtagtcccggctactctggaggctgaggtgagaggatcacttgagccaaagaattcagagccagcctgggcaacatagtgaaaccttgtctctaaa

SEQ ID NO: 12608 - DNA, 343 bp, Homo sapiens
atcctatctggtagggagctgttaaatcatttagttcttggaaagcagtagcacttaatttgtggatactgttatcctaaattagagaagatggtaaaggaaggaatggggtagatcgagcttaagccaggtggtcctggtggacaccagacttgaatggtagcccttttgggggtagtccttgttgcgtggcaatcttccaaccattccaaatgaggggctctggaaaaatggttcccctggtaataagcagtagtcctggggttgtgggggctgggggaggtagggatttacttgtttacccatttaccttgtttggcaataaaattgacatctgataata

SEQ ID NO: 12609 - DNA, 863 bp, Homo sapiens
tgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaaggttctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactc

SEQ ID NO: 12610 - DNA, 491 bp, Homo sapiens
cttttttaataagtaaatggagtacagtctagaataatgataagaagtatagtgtagtaaatatataagccagtaacagtcatttatcatcattatcaggttttatgtactgtacacaattgtatgtgcaatactctgtgtacaactagcagagcagtaggtttgtttacaccagcatcaccacaaacatatgagaaatgccttgtgataggacattaacaacggttacaatgtcgctaggtgacagaaatttttcagctccattataatcctgtaagatcaccattgaatacatggtctgtggttgaaccaaactttgttatttggtgcatgactgtatatacatttaaatattttgttatttttattataccactggactgtaaaacctatgaaaacagagatcttatcctttttatttacccctacatccccaacatttggaattatacctggcacgtagtagccactcaataaataattgtgcaata

SEQ ID NO: 12611 - DNA, 686 bp, Homo sapiens
gttaaaaggtaatctgtttagcctccctttccccattctcctgccagaaaagagggagttcaagtcttctttccaggactcctgtgttttggctgagactgattcttcactgtggccttgggagaaaagctgcctaaccagttctgggccctggctagttacaaccatgtgtgagttgtttacagtacgcacaggtatgggctgaagggaaacaaagcttaagggatgactagaaaggcttgctgaaattgctatgggagggccccaccctccaagccatctcccctcacaccccgctcggtttcagtttctgcagcttggttatgcgacattctcttaatccttttttgaatctggtctctacttaagcactcaagaaaactgctccacaaggattgttttagtggggttttaattttttaaaatgttcttgtttatttaaattgcttgaacaagggtttagctgtatgggaagagttcctgcctttagctatacatgtttccacccacttagacatgctgctcacccacagactcatacagcctccacagacacaaagcttctgtgtatcctacatgtacctgcaccccaattctgtcaacctccccacagctcttgactggctgtttatctattccattccactaccttcccaccccagccctcaaagtcccaaacagattga

SEQ ID NO: 12612 - DNA, 304 bp, Homo sapiens
aaatatgtcatctgttttgagtaaattattatataaagtaaaaggcctacaccaaggtattttatttttaatttttaaatttgcatatggatattcaaatgctctagcaacatttgttaaaaagacttgttttttattttatttttgattgtacatatttataaagtatagtgtgatgttgtgatacatggctaacttgtataatgatcaagtcagggtaattagtatttctgtcacctcaaacatttaaatgttcttaccataaggaactgatacatgtttggtcgacgcggccgcccaggaa

SEQ ID NO: 12613 - DNA, 385 bp, Homo sapiens
gtgtggatgctggggtggatacaggaaaccattcccatggctggggagaaaacagagccaggacatgactgcgggctgcatggctccggacccaggtggcgtcttctactataggctgcagctggattcacagcacagccaccttcccggggtgactcaggcctcagggacaagaactggatggcacccagagagcctccaggcatgcccaacagactccaaccaaagccagggaagatggctcacacctgctctgctaggtcagccagcattctgggcattccaaaaattcctccatgctttttgctgccttctcccctgccccgccgccccccttccctaccttttaatgaattaaaggacaggaaggcagaggggctgtgat

SEQ ID NO: 12614 - DNA, 2149 bp, Homo sapiens
gtgttgtccaggctggtctcaaactcttgggctcaagcaatcctcccacctcagcctcccaaagtgctgggattacaagcatgagctactgcacctgccctctgtttcctttggaaatctcttacctttcattagggtttctttcatagcaatttcctttggtttttaagacttctacattgctttttcttttattatctgtgctccgtgaaccttatgaatgctgcttaaaaataatgtcaaaatatgttttagctgcctactcaggtaacgttttcttttgctctcatcttggtttccatatactatttttggttttttgtgagatctaatcaatgatctagtcagaagctacttcactggctaacagtgatcatgttcatgtgctaaaaatgaacttgaaacacggaagtagtggttggtccagtttgaaagctcttattagtattcttcatcctggctgtaataatagccattatttgttatgcctttgttatgtagcagacactcttaaggattttatgtgtattattcaaattgctattactgttctttttatagttgagaatctcaggatacctacatttatcactttttcaatatatatgtatttcttattcttattttgtcttggagtgtttaatgtgttatttcctgttcattactttaatattatggtatctaggcttgtctttattaccatgagcaaggtctccaggagttccacagtactgaaggaaaattttgtcatatccctcagaagaactgaatatttattattggtatgggctcctttgtttattctcttctcccaattaatagattttaaatgaaatcttattagctagaaacaaaagccacttactccttgctgagagccaattacttaaatatatttcttccttataataaaataatttgcttctaggagcagaaatctatcttgccataccctttggtttttaaagatttctcttctatttgcatttctgcactttggtggttctcccatgaagataattatggtgtcataaaattcacattccactggttcctttgaatcttaccaaccactcttgttaacagagacaatgaacctgaactgttttaggactcttgttattactgagacaggtcacaaacatcaaaataggagtccgtggcttgtagtgatgctttttagtcttgtgatagcacaatccatcactttccccaaaattcttgtcatagaacataatgaaaaatatgtaaaatacccatttatgtggcatttcattcacttaagttgcagttaactctaagccaaattataccattttttctctctgtactttagctccttgaatttccttaatctgggaaacttttgttcccacaccaaggaacaaattcagggggtacaagtgcaggtttgttacatgagtatattgagtgatgctgaggtttggggtacagatcccatcaccaggtggtgagcatagtacctaacagatagttctttaatccatgccctcctctctccctccctgctctagtagtccacagtgtctattctggtctgggaaattttcatcactttccaccaatcttctatttattctccaaatgtcttccaaagtatcctgccccaccccctcctcatcctaagagattcctttaacttcaagatcatatccagtgattgctgaaaaatgtctgccatgcacttgctaagctagtgtttttaggcattaacatttattatcacatccatatttatatttttgaaataatttatacttctcactgatatcatctaaacagatgcttctcacagttttatgttttgttttttgtcagggatgaaagacaagtgagtggtatcacttaagggaaagaacagtaggcttaacgaatagcagacctggattctagttctggctttgtcatttactagctctggtaccccaggccagtcacttaccatctctggttcggttctcatctatcaaacaaagaggctagacaagattagaaactaaaggcagaagacaaggtagaaaaatcatatgattttgggaagagcattttgtcctttggtttagaagaccaggctgcccaaaagagcctcctattttatccataacccctgatgataaggttggtggga

SEQ ID NO: 12615 - DNA, 510 bp, Homo sapiens
aacttaagtttacttaaaattttctgaaaagaaatgtacaaagacagccttcaattaaggattaatcactatggcaactgagatgtggtgactgaagggggaggatgtattctcccctcagtttcctgccagctgtcatagtcaacctctgctgcctgaatccaagccaaaatatagactgtgaccaactctaagaaactatatctgtatttttataaattggtacaagtatcagactataaaagaagacttaatcccttgaattggatgacagacacttggcactcttgcaagtgtttgacagagaaataacgggtcgctttgtagtaaaacctggattaatagtaagcccctctttatgttattgcagtgtggtgtaaatgagagaactaagcatgctgtcagcctggggtgggaggtagcgtgggggagtgtcttttatataaccagtgcaggtttaagcactgttcagaatactgtaaatacaaaatattgtgttagtaaaaaaaa

SEQ ID NO: 12616 - DNA, 1459 bp, Homo sapiens
atgtgctgatgtatgtgctctgccagtgtgaagggtgaacagctccaactttatgtccccccagggacatagtatgagatcggaaaatagttcttagtcctgtttgtcttaatttttattggtttccaaggtctcctaggaaggagagcagagctgtgtggtcctaatcatggtgtcgatgccagatttatttgtaggtccagaggtctccctgagaagaggcatttgtgacaaactcaagtgctgggacctgcatgaattgtttatttgcagtgatgcttcatatttcccagcactgttcatggtatcttatttcccaggtccttcattgtagccatgggcactgaaggactgaattggtaggtaggtcactggttgtaagacctactggggccaggtaagaacagtaattggcccagacaggtaggtgtgataaacagagtagaaaagattgtggccaagaagagtgaatgtgtcccatccaaaggtgcatccagatatgtctgtgttactatggcttcatggtttgggggtatatagaaattctcaggacctcagacctttgattctcctttagcaacacacatcgtcagcataaggcatctaaagattttgtggactcataacttatgtactgtttttgagatgattgctgcacgggcaggaaagcaggatttgagagaacatacaccttgccttccagatatgtggtttttgtgattcacccagatctgttgtgccagttaggaattatctttattacttcccgtttattgccactgctgagaaggctgtccttcctaacttgtgaggagatgaatccttaataataagtaaatcttgtgttatcctatagtctggttttccaaaaggagaggtagatgcatatttttgtgtggaaccatttatcttaaaacattgaggtgcagttttcatacacaaaaccttctatctttttaagaactgtctgtatggtttattgcccagttaatgggttttgatagtcatgttatctcagtaagtgtcttgtcttagaaatatgtgtgtataggctgggtgcggtggctcatgcctgtaatcccagcactttgggaggccaaggcaggtggatcacctgaggtcaggagtttgagaccagcctgaccaacatggtgaaatccagtctctacttaaaatacaaaaattagccaggcgtggtggcgtgcatttgtaatcccagctacacaggaggctgaggcaggagaattgcttgaacctggggggcggaggttgcaatgagccaaggtcgcgccattgcactccagcctgggcgacagagtgacacttctcaaaaaacaaaaacaaaaacaaaaagaacagataagaaatacgtgtgtatatattctattttgtgtgttttcattcaccttatttcattcagtcttccaaatgaaatgttcttaattttgatgaagtctaa

SEQ ID NO: 12617 - DNA, 848 bp, Homo sapiens
atgtgctgatgtatgtgctctgccagtgtgaagggtgaacagctccaactttatgtccccccagggacatagtatgagatcggaaaatagttcttagtcctgtttgtcttaatttttattggtttccaaggtctcctaggaaggagagcagagctgtgtggtcctaatcatggtgtcgatgccagatttatttgtaggtccagaggtctccctgagaagaggcatttgtgacaaactcaagtgctgggacctgcatgaattgtttatttgcagtgatgcttcatatttcccagcactgttcatggtatcttatttcccaggtccttcattgtagccatgggcactgaaggactgaattggtaggtaggtcactggttgtaagacctactggggccaggtaagaacagtaattggcccagacaggtaggtgtgataaacagagtagaaaagattgtggccaagaagagtgaatgtgtcccatccaaaggtgcatccagatatgtctgtgttactatggcttcatggtttgggggtatatagaaattctcaggacctcagacctttgattctcctttagcaacacacatcgtcagcataaggcatctaaagattttgtggactcataacttatgtactgtttttgagatgattgctgcacgggcaggaaagcaggatttgagagaacatacaccttgccttccagatatgtggtttttgtgattcacccagatctgttgtgccagttaggaattatctttattacttcccgtttattgccactgctgagaaggctgtccttcctaacttgtgaggagatgaatccttaataataagtaaatcttgtgtta

SEQ ID NO: 12618 - DNA, 482 bp, Homo sapiens
tgttccggcgccacctttaatgggtgttgtgatgtcggttcctgggacccagtttcttcatttacttgtgaaaagaatggtactaaattgtccaaagtccctgcttaaaaatttagcagctgttttttctgtcatttctccattgacagacttggtcgttaaggttattggatcaaaaagagatgaagtatgcttccagttgagaacagcctctgcatgacataaaaatggcgcccacaagaacggaactgttttgatgtcagaagacagtatctattgaacagcattactttcctgagttgggtaggattgccctaaaatgactcgcaaaggcaggcgagaccacagcacacattagtcatcctcgttgccccgctgcggttcggcagctctagtgctgcctgcacagacacttggagctacaacttaagcatttgaaaattgagggaaagtgattaaattggcattgaagaaccctcatt

SEQ ID NO: 12619 - DNA, 2915 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaataaaaaaaaaaa

SEQ ID NO: 12620 - DNA, 2618 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttac

SEQ ID NO: 12621 - DNA, 2491 bp, Homo sapiens
tagctagtacgaggctgggtgttaaatcgggcgaggctgcgagggcttccgcaatggttaatgtccaccgagaagggcttcggttggatagccaaatggatataccaaggtccagaggggtatgatgggtttgcgatcactgctatgtgagctgtcgaatgtgctaaaagttcacgtgtggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaataaaaaaaaaaa

SEQ ID NO: 12622 - DNA, 2095 bp, Homo sapiens
attatatcttatacattgacaactacataatcccgatctccacacccaccctctagccacttactacccttgacggattctttcacttacgaggacaacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaataaaaaaaaaaa

SEQ ID NO: 12623 - DNA, 2861 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaataaaaaaaaaaa

SEQ ID NO: 12624 - DNA, 1434 bp, Homo sapiens
cacgcagtaccgagcacagggcaatatacctcataagagagaatgcggtctggttcaaaaaaaatcaccaagatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaataaaaaaaaaaa

SEQ ID NO: 12625 - DNA, 2892 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaa

SEQ ID NO: 12626 - DNA, 3248 bp, Homo sapiens
  misc_feature (2897)..(2897): n is a, c, g, or t
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaaaanaaaaaaaaaaacaacaaaaacaaacaaagacactgtgtgtgtgcgcgcgcgcgcccctgcggccctcggagaaaagagcttttatatagaaccacttgcgcgttgtgggcgcgcgcgcggggcccccgagtgatggcgtatagcgtgtgaacccagtgtggcgcccatatggcgcgtgtttctcctatagaggaggacacctccggggggcccgtgaggacatagggcgcggcgggggggggttttctctctcccacccctattttttaacacagaaacgcgcgcccgcggggggggggccaccccccgagagggggtgtttcttcttggcacaccaaaagctcttccagg

SEQ ID NO: 12627 - DNA, 1463 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaataaaaaaaaaaa

SEQ ID NO: 12628 - DNA, 2837 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatattttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaa

SEQ ID NO: 12629 - DNA, 2359 bp, Homo sapiens
  misc_feature (2232)..(2233): n is a, c, g, or t
  misc_feature (2242)..(2242): n is a, c, g, or t
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaaccctccccagtgaatatgacactcctctctactttgannagatgaagntcggtatcttcagtcacacaagctatacatgatgataatccaaagtattcacagcactaatgctgatcaaaatttgctctccaccaggaaatgtaaagccacaatgtctcaaaacaa

SEQ ID NO: 12630 - DNA, 2311 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgagacttggtcgttaaggttattggatcaaaaagagatgaagtatgcttccagttgagaacagcctctgcatgacataaaaatggcgcccacaagaacggaactgttttgatgtcagaagacagtatctattgaacagcattactttcctgagttgggtaggattgccctaaaatgactcgcaaaggcaggcgagaccacagcacacattagtcatcctcgttgccccgctgcggttcggcagctctagtgctgcctgcacagacacttggagctacaacttaagcatttgaaaattgagggaaagtgattaaattggcattgaagaaccctcatt

SEQ ID NO: 12631 - DNA, 1448 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgacaccagaagattccttcgctcttgctgtcgcctctgcctaagaccctccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgaccggtaaataaatgactgtaaaagccccatgcctaggaaaaaagatcagaaagaaataaaccaaaatgttaacgtga

SEQ ID NO: 12632 - DNA, 1747 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgacaccagaagattccttcgctcttgctgtcgcctctgcctaagaccctccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgaccggtaaataaatgactgtaaaagccccatgcctaggaaaaaagatcagaaagaaataaaccaaaatgttaacgtgaaaaaaataagataatggcctctctgtcctaatgcgtggaccccgcggccgctccccttgagcgaggggtatcatgccactcactcctagccccccgcgttccgcgcacggttgggagagtggaccagactcccaaaggcagtagtcggccttccccgatgcgggtcgacccaccgaaaaactgcgtacacaagcgatctaaggatgcaacgtaacagggcgctagttgcgaaatatctgagatcgccccgtgccagcatataaatctcatctcctataacgcgcaaccggagaggtaag

SEQ ID NO: 12633 - DNA, 1483 bp, Homo sapiens
tccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctggtctgactcacctctggttccctgctattcttcagacaccagaagattccttcgctcttgctgtcgcctctgcctaagaccctccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgaccggtaaataaatgactgtaaaagccccatgcctaggaaaaaagatcagaaagaaataaaccaaaatgttaacgtga

SEQ ID NO: 12634 - DNA, 1918 bp, Homo sapiens
gagttattttaaattgacggtaagcttgaaatttaagaaatcttcaaatagcttttaatatctgactgtagtgtttttcttcttctttttttgaatgagatcatttgttcccaaactcaattgattattagagttctttttaataaaattaaagcaataatgcttggctttactctaaacaaacaaaaagaattaacccaggaacctctgtagcaaggtgagcagtgccctacccccagccccacagtccacctgatggtgttgaggccgccaccaggccaccgtggtccctagcgaagcttccatccattggcacctcacacactcatctgcacattggtttttgtttagcttccatgtaaatgggataaaacaattcctttttccctaccaagtgttaaaaaaaaaagaggtttatctcaaaataaagaaattgatgacaaccagtgctgtgttttccctaatacgactacatactttttaacctaccacagtcctggcagaaacattgctaacctgtagaaggtttattcaggatgctggtactttgtcttacagtggttatgttcctgacattctgcactctgcactcttgttgaactgtttcccattgtaattataagatctcatgggaaatttactggagtagaatttaagaaattctattttttaacactacaaagttgtttatgatatatattacagttaatgtctttttaaaaataaagtcttgaaatcaaggcttggcttttaagacgagattttcttttttgtgtgtgtctatcctgacgatcatcttcttattgtcagtctaccctgactatcactcagggagtaggtagaatttgtaacccagcaacgctgtctgcttctaacaatatcccaaaaacctgattatggtagtagaaacagaagaatcaagtcagtaacagtaattccaaaccagtgacagcaaggaaatgctaaagaaagtaaggggctggatgaacacctaggctagagattctggtgaatataaactaatttcctagccactcagagaaataaatgtaggaagggttataaggtgtggtactaagctggaagaaacaacacatctttatatcttgcatgatttgttcaaacttaatgtaagcagcaggtttcctttgttgaggatttttcggttgatatgacaaggatacttctaagtgactgttagacagtggtattagttcccatacagagagtatgttggaataatcagtgcttgcatttgaatctgcgactctaccaggtgggatgaaagggcagctggaaattcaggcacaacggagggaagttctttttcagggtccttctgtttgtgtattgaaaaaaaaatctaaaacatttatatttagatgagtcttacagtctcaaaagcccatttttacaatagcagacaagtctctccgaacaacctgtccccccacaccctccgtgcacacaggtctgactcacctctggttccctgctattcttcagacaccagaagattccttcgctcttgctgtcgcctctgcctaagaccctccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgaccggtaaataaatgactgtaaaagccccatgcctaggaaaaaagatcagaaagaaataaaccaaaatgttaacgtga

SEQ ID NO: 12635 - DNA, 556 bp, Homo sapiens
ttttaaagagctttgtattttctggggactgtgagctgatgttcctactactctaagatgatgaacaaaaagacagaggatggttcccgcgtgaccctggctctgattcctttatgggatatgtgtaaccacaccaacggcctgacaccagaagattccttcgctcttgctgtcgcctctgcctaagaccctccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgaccggtaaataaatgactgtaaaagccccatgcctaggaaaaaagatcagaaagaaataaaccaaaatgttaacgtga

SEQ ID NO: 12636 - DNA, 681 bp, Homo sapiens
aaagaatgtaatccatcagaacgtgagctccttgtgcttccagtgacaagcgggccacagtgctggtggcatgttgcttccctcacagccctgcccaggggtaggaccaggcccgccccttgatggatgtgctgttgattgtaatatacttctgttgccaaataatggtactgtttaattttccataaaagagagactatattgtctgatatgtaatgttaatggaattctaagaattactagacactattataaattgtagacttacgtatttgtctaaaggtttgatgaagcagggccaaaacattgtttcttcttttttgtttgaaagaagctgaggtttgtttttgctgtttgagtgttcctttggcaacttattatgtgtgaaatgttaaattttaccgattaagatgatggtaactgagacctttctttaaaccagtagcaacatcagtacaaattgctcttcctgtgtatcttgaacctaaaaagaacaatctcttcaaaaacaaaaacaaaaacaaaaaacaactctttggtcattttgacctgtgtggtttaaattcaaatagttcatgaataaaaggagaaaagccaatctgttatagtggattattttgggttctttctgcttcactcttttctgagagcacaggaagctaacagccctgcaaatggtgt

SEQ ID NO: 12637 - DNA, 297 bp, Homo sapiens
ttgagggtttttttaattacacaaaccaccttgagggagtcaaaagaacataggactgagaggcaggaggcctgagtcctaggtcgctgcttgcctcttgagtgaactatcactgccctatttgtaaaatgaggagggtctatagatagcctccagctctaaagctctataccactgaactctacatgagtactctaaagattatttagaggcatcctgttgagatttctgatctccctggctaccacaaacattaattgaaaagctgttttatgctagaagctgagcctagtgcaa

SEQ ID NO: 12638 - DNA, 364 bp, Homo sapiens
gaaggatattacacagaatattacacatatcataggtatacagcttgatgaattttcacaaactaaacatacctgtgtagcttgcagtcagatcaagaaactgaatactgccagcatctcagaagccatccatgtgaccccttcaagtcattattctttctggggtaatgatcatcccattgtcaatacattttttaaacatgttttaaaattgagttcataaccagatttaagccatacaaaaatttcagtctcattaaactattttgttggctaattaatttgcttgcttatctcatttattttatttactacaaatgtcctttgactgtgaaatgaaaattaaacttaaaaagatgagttt

SEQ ID NO: 12639 - DNA, 492 bp, Homo sapiens
cagaagtgtaaatgctagctcaattatggagatctggaaaggcagtctgtggagtctggattgactctctcgggaagtatagagaccctaaaggtggatgaactgatagcctcccaccccatcaaaatacaaggcataaacatgtatgcagtgttttttatcttataatatcggcaaattgaaaaattgagtctctctgcatggaaaaggaaaaatagcactaggcatcatttaataaaaaactctctttttaattaaaattaaatgtccactgtaagaaaaaaacaagtggtgagcaacaaatacccacagccttgtttaaccacctgtgatgaattataattaggatttgaaaattattgaacttttttccccctgttcaccttgggctctctgaaggtgaatttccaagagtgcaggagggaatgaatattaaaaagtttgttttatacttggatgccagagctcccatctcatttttccattaaagct

SEQ ID NO: 12640 - DNA, 423 bp, Homo sapiens
cagtggcgacgagatctcagttcactgcagcctccacctctcaggctcaagcgattctcgtgcctcagcttctgaagtaactgggattgcaggggtgcgccaccacacctgggtagtttttatatttttagtagagacaaggtttcatcattttagccaggctggtcttgactcccggcctgaagtgatctgcctgcctcggccttccaaagtgctgggattacaggcatgagccactgcacccggcctgagaacacattcttatgtgactccctagattgttgcagataaaatgagaaaagtaccacaattttctgttttgtttcagtacataagcatttatcaacattcatctttataagtgaaccccaagggcattgctagtcctgggacagaggaacttcaccatcttttgtttgtttt

SEQ ID NO: 12641 - DNA, 115 bp, Homo sapiens
cgatctttaggccctttttccagctaagacttgagaagaaaaacactagtaaaccttacatagagggcttgcttacagagtaaatgtaacaagtttctttgatgtgtgaccaaaa

SEQ ID NO: 12642 - DNA, 350 bp, Homo sapiens
tttggtgttgggaggaatctcatgggcatttttttaggatttgattattttctgttgtatctcattgtcgtctttttaatagctgtagacatctaatcctgagctagtgttttactgttctgttactcataaaaattctgaaatgcaggggttaagaatagacaatcaagtcttaagtgctttgcaaaatgaatttattcctttgagaattaaagtgatgtcctgaaggaagtcacagttaatggtcagtttcctttagggaaatattcttgaagaattagagtgctgctctcacatatctttgatggaaaccaaacaactcctgggttaatgtttagttaaatgaacca

SEQ ID NO: 12643 - DNA, 443 bp, Homo sapiens
atcacttttatctctttaatagaaattggttaaattataatcaatataaggaggttacaaaactccatatacaacactgtatacattttcttggaaaaatatgtgcaactgctctgcaaaatacatgattaactagcctgtgtgatgggataacattgtagtttcttaatttcttgtcctttcttgtatttcccacagtattgatgtatatcttctgcgttcaaaagcaattttttaaagcctcataacgtggtaacaaaatactatgcacgttacaaaattcagaacacggaaacaagaagctcgctttttttttccccctatttcggtttggccctttagatttcccctcccccaccggggcgggacttcccgccgacttctttcaggttctcagttcggtccgccaactgtcgtataaaggcgctgcctcaggccagagt

SEQ ID NO: 12644 - DNA, 527 bp, Homo sapiens
tacagcaatgtattaacaggtaatgttgcaaatcagtcaaggggccaagtgaggaggaatccagaggagtagaaagaatactaattttctgccaaattttacactcagaggaaattaatccatcatagaagtcttccatgaaaaaaataaaaaaggtactcagtatgacccagaatagccatgaggttaaaacacatacacacacacacacagcaattgccacttccactagagtttgacagttatagatttgggtaattatagtagaaattgcgcgtttggaaacacactaagaccacaccctaagactgagaatctggactttaaacgctgatcattaattaaaaggacaacgcagtatctaagttggaagatctggccgcgcaggtggaaggcgaagtgatggggagcgataaagacaccaacttcaaaaccagggaccaggagggctgggtgtcgaggcgaggcgaggcgaagcccgggggataagggggtgtggagctggggacgggaacaggggatgagga

SEQ ID NO: 12645 - DNA, 745 bp, Homo sapiens
tgttccaaggaaccagtaattaatgcatggttataggtatacctggcttcaaaaaaaagaagtagccgtggaaagctatatgagaaaatcacaattttctgaatcaaatatttgtaaaaccatttggctatttaaagactcttagggtaaatactccctggaaaagcaagcaatccagacttatctggtctgcaaaccttgatttcagcttaatatcctttcctgaatctaattcattttcacccactaaggtcatttcatttaagatccattgtttttgaaattttgaagtagcccagtttggcagctctcagcacctgcctctgccctctcctatacttcaactatattgaactctagcttcaatctagttcctactaatccatggcaaaagttattaactgataagcccaatcttgttcagcacgttcttctaaatgcctgacctaaataacttctgcttgggttaacttgtgttcattctcaccttaggcctcagtgtggaaaggtaacacttaccttctgtgcaattgtcctttgtacaactgaagactgttaataaattcaggtctcacctccatgtctgaaaaggctatagtagctattcatggagatgggaatttgtctaattacctagccagagtttgcatatttaaggtaatatattcagctaccgtatcttttattcatagtgcctgttttccagcctttgatcagttttgtagttcccgtggataaactccaa

SEQ ID NO: 12646 - DNA, 595 bp, Homo sapiens
gcaatttgcttccggttgtatttctcaggaagtccgatgacactcggctgtccaggccaggcgctggaagtcccccaggaggaccagctcggtctcccacctcttgagtgcacagctccttggcccctgagtaccccaccacccccatttccagccttcttccttacaaacacgaagggtgggaggaaccagaaaacaggggatcccgcagccctaggctagttctgatcgctttcaggtgtctgcagaggcaagttgctggttgtcacctgtaaaatggggaggataaaaacacctcccagattttgttctagatcctagggggatgtgaggctcaagggagataaaggacactggagagcaccctagaaatgacaggatgaaggcgatggtgacaaatatccgagcgaaacgcttgacaatgagaacagacaagtgcaggtctccaggagtgccgcgagcgcccgcgggttctgagagcgctcaaagccgccgagtcaggctgcccagcccgccgggcctcgccgcagtgatcctcattcccgaatctggcagcgctgtcaaaggcttgtattaggaggtgaacggcggccgc

SEQ ID NO: 12647 - DNA, 1382 bp, Homo sapiens
caggttgagtccttccacctcattatcatcctaggtaggagtggaagatgaataccagcctgtgagccaatgctttcatttttggctgcagccaactggttgtctaaggctgggaaggggttaagatgcccccggagcttgccgcgagggcagctgcctcagcgggcactccgcctggatgggaatataagcactcttggtgttgcccaggcagagagggcagtgtggagggaagttgctagaaaaaggcaggggacataatccatactggcctctttcccaggcacatcacagtggcagaattatttatgattctgacccaatggggatccctctacttggggagactgccaacccacgccctcctgaatggcaacgtcctcccacagagacagaggggaacaagtagcatttatggagcggcacagaggaaagagtgtgggctttggagacagcacagcagcactcacatcccggcccagacacttcctgtgtgaccttgagccagttgatgaacctgtctgggcctctgtttcctcatctgttatcggcgaaaatgtttcggaggacacctattgtataatgttgctatgcagattaaatgcactagcagaggcaaagtgcatagcttagaggaaggaagtactcgctaagtggtagctggtgtgataggtgggccaagtcctggcaggagctgggcttgctggctgccctgttttgctgaaacagcagcatcaccatcagcagcaactgtggaaatatagacccttgataaatacaggtgaataaaatgaatgattagaaactggacctgccactctgcagaacccaggcactgctccccagcagctggtgcctcaaagcagctgctaacatggcaggagacagtcagaccagcagtgaatagctatgcttcgtaagacttcatacacaaggcaggcgtgtggactgaccagaaaggtggcagtcactgtccatcaagagaatccccacctgttttccaatatgtcagccaggaggctcgcactcccaaaaggaatgttctcagccagctccctgactgtccccacctctgacagtggactctcttgggtctctcaaaaggctcctcctcctcagccatggggtgaaggaatcctgtttgccggggaggcgggatgctgcccagggtggctgttttgggagagcgagcaggatgagatagtgcctatgagtgatctttggagatggaggtgctatggccacctgtggggactgcctgggtgcctcctggccactgtcaacttccttgctcacactgaggttctgtgattctcctctgagcatttccatggataatttttttttttcagagacactattaaagattttaaaaattgcaa

SEQ ID NO: 12648 - DNA, 714 bp, Homo sapiens
atagtagattacttcattataaggattacataaaattcaatgattactgacctagttaagctacctctgaatgtgaaaggacaagtataggtgcacctactttaaattgcacaatataaatcttttcatttattcaaataatatttgaagttcagttaggttttgcaaaattactcgtttggatgtgttaagaaatcatgtaaactcttcctttgactttgggggaatgaacatgagatttgtttattcttggggggcagttaattttgtattctagaaggggggttaatgtataatatattttagctaagagaaatcagtttaagataaccaacttttcttaatctaacattttggcttatttctgtcatctggtcattctcatacaaataatacaaagctaaatatacataataccatatgcacatatatgtatatgtatacattatatgtaatacataaaacaaagctaaatttgtattatggatttaggagtgtaatggaaaatacccctttaagaggaaaagcacaaaactgaattagtcaagaaaataataaatgtttgcaataagtgtcatgaccgggtatagtggctcagtgctttgggaggccgaggcaggatgattgcttgagcccagaactttgaggctgcagtagacaccaattacactactgcactccagcctgggtgacatagtagaccctatcttttaa

SEQ ID NO: 12649 - DNA, 498 bp, Homo sapiens
gggactgaacaagattacagtatagggcttatattgtatgagtcttagagaagttggattctacatagctggtggccttgtagctgtgtcaaaaaaaagaactggctaaatacagacatttgtaaaacatagtcatgcttaagagactagggaaatgagtaacagtagaagaatttgtctttctctctctctctctcttttttttccttcactttgttctggaatttaaaaagtgtctagagcccattactttagccttagctttttggacagcgttatcttataactttccttgaagtgagctgctaagcagaagaaaacttgtttctttttctttttaacctttaccacaattctgtgggccaaagggatcaggagacagacatagagcagtagaaaacctgagacagagaaaagaagaatgagagagactcataacagatggtaaagtagaggaggggtgagggatttgccaagaggtgacaaaagtgaaaaaaa

SEQ ID NO: 12650 - DNA, 1209 bp, Homo sapiens
tgggggttataatatacccttcgaggccatctatctccctcatcacacatacaccaacttaatataaacccttttcagagaagataaaggaattagctgtttaatgactacattgtggtgaagttttaaagccactaaatgggaggtccattcccatggcaccattgctagcagcccaaacacagtctgcagaaacactcatttcagtggctgacttcagtcagtaattgatacagcaaaatttcattctaacatttcaaagctgtctcacagaatttctgagaaaaaagtgttcccaatcactgatttcatcatatcgcgtcaatattacttcagcacctttaatgaggaaatcattgaaacacactcatcatctttggctagagagatttatgttactcagaggttttgcagctggtgtggcagtgggtggcaatagtgaatttgcagttttgaaaaaaattaaaaagttacgagaagaaaagagaataaacaaagagaaagggaaatgaagcaagaacaaaagagactcaatcatagtgttagaaaattcctgcaaacttcttgatcctgaagtctccaaaaaacctcagacctcccaccgatgttacagtatctttcatctggggctcaatctaagaatcttttcggttcctggtaattcctctgagtgcttcatgtctgtcatcacagttttattaaagaactttacttgtgtttggaaagattgtgtgcatgcgtgtctgtagccagttgcagacgtattgtctcagtaagaaaataaatcctatttgttttatgaaatcagtacacaaataacagttgccacagtgtaccagtatttcaatttctaaagaataccatagagtctgaattagaacctttaactagattgcaaaggaatatactaaattgaaaacttgtaaaagggaagtaataaacaccataatcctagataagatcctatggtctttcagagtttttccatatacagtaattatttgatgtacagtaattattgataaccaaaatgacaaaaactgaatctactcttcaaattcaaccatgtatcttaaaaaggagtaaaatgtactgttttcagtgtttcctttggtttcttacagtttataattttataaattaacttcatagaacatattttataaatgttctgtctctcctaacataaattttgaattataccattgt

SEQ ID NO: 12651 - DNA, 291 bp, Homo sapiens
tttttttttaatcataactgtgtttacgatttcggtttaaaatatcaattttggccaggcacagtgggtcatgcctatgatcccagtactttgggaggctgagtcaggaggactacatgagaccaggagttcgagaccagtctggaaaacataaagagacccccatctcttcaaaaatagaaacaaaaaataaatatcacttacacttaccacttacagtactgtgttctactttgactgaaattatttacaaaagagttttttgtttgttttttgtttttttgagacaga

SEQ ID NO: 12652 - DNA, 535 bp, Homo sapiens
aacttgtactttccttgcctttactgtggagttgaccattttttcagagagcctcggttgcttttagtgggaaatggtatttagaagccatggatgctaaatatgctctttgtaactgaagtaccattatttatagtccctttcagcagacagaggtagtagatatatgtatgtacacatagacacatacacacacacacccatgtacttctataaatagctatttctttatctgtctgtatatttatatatattaaagcctatgagatcatatcagtatctttcattccaatccaataccacatgttttatttaactttctcccctttcctgttctctgaacagtgagaaacctggttcctattatccataacacacattttcacttaattgctcagtcctagagtgtacagaaagttgtttcagaattactaacccaggccgggcgcgatggctcacacctgtaatcccagtactttgggaggccgaggcgggccgatcatgaggtcaggagatcaagaccatcctggctaac

SEQ ID NO: 12653 - DNA, 340 bp, Homo sapiens
ttgtggaaatctattttccttgaatgtagctcctctaaggtacttaaaattatagctttagtcttgtttacaaaatttacttcaggtgctgaagtaaatcccattcaacattaagagaatcttcatgaatgtagcagtataattggacctggtggccctctctgaatattattgagaaaggttgtggtcatttctttctattttttaatagagacagggtcttgctctgttgcccaggctggggtgggaggatcacttgagcccgggaggcagaggttgcagtgagccaagatcacgccactgcactccagcctgggtgacagagtgagaccctgtatca

SEQ ID NO: 12654 - DNA, 437 bp, Homo sapiens
aaattgtgttgagttggtggcagaagaggcacaatctgatggaatgaaggaaataatgtattcttgattggtctggtctttgcattcctcatatgtgtcttccattttctttttattaaatatctctttattttttccattaatatactttactcagatcactgtgactgcttaatagatactacacagtaatagtagctgttttcatgtgggagataaaaggatgaactagtcagagatgaatgttaattgggtgcatctaataagcctgagatttcctgcttcagtgtcatcatgggagttgaggcagagcatttggaccttcctagcatgtcacctactgaatgctcttgacccgttctgaattgcctacactgggcagtgcaggcatgacagagtctgcgaccaggtagcccttcaagctgcattggaggcat

SEQ ID NO: 12655 - DNA, 420 bp, Homo sapiens
gtcttctgcatcagtcatgctgggagctgcagattggtgctgttcctattcggccatcttggaatggactccatataaacttttaaattagtgtgtcaatatctatgattagccttctgggatttttaaccgcaattttttgagtactgtattagtttattctcatgttgctataaagaacttcctgagactgggtaatttataaagaggcttaattgactcacatttctgcacagctggggaggcctcaggaaacttacaatcatggtggaagaggaagcaaacatgtctttcttcacatggtggcaggaatgagaagtgcagaacaaaagggggaaaagccccttataaaaccatcggatctcattgtgccattgcactccagcctgggcaacagagcgagacttagtctcaaaaaaa

SEQ ID NO: 12656 - DNA, 287 bp, Homo sapiens
ttctcttcatcagggtccgcatggaatctttcttatattttaccctttcctacatgtagccttgaatgtcctttccacgaatatgctcccacggctgggagcattttcttttcttttcgtcacctttgatttttgggattagattaataggggaaaaagtccctggctttaaagaaaacaaaagtagaattcttcaaaaataaatttcatactgggaacagaaaggaactaaatgcttcataaaacagggaaaaagaaattaagatcatcctagaaataaactaaga

SEQ ID NO: 12657 - DNA, 438 bp, Homo sapiens
cacctacccaggaaaacaacattttctttttttttctgagacagagtcttactctgttgcccaggctggagttcagtggcgcgatctcggctcactgcaacctccgcctcccgggttcaatcaattctcctgcctcagcctcctgagtatctgggattacaggcgtccgccaccatgcccggctaatttttgtatttttagtagagatggggtttcaccatgttggccagactggtcttgaactcctgggtgcaagtgatccacctgcctcaacctcccaaagttctgggattgcaggcgtgaggcaccgagcccagccacaacctcttttatctacagtaaccagcctggggtgccaacctgctataagtcaaacttgcaggaagccaggtgctatctctagtgacaatctaggaagctagtaattggcactgtggc

SEQ ID NO: 12658 - DNA, 354 bp, Homo sapiens
ctatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatgga

SEQ ID NO: 12659 - DNA, 418 bp, Homo sapiens
tgtgctgccacccaggctggagtgcagtggcagcacaatcataacttactctgcagcttctaactcctgggctcaagcaatcctcttgcctcaccctcctgagtagatgggactacaggtgtgtgccaccatgcctggctaattttttgtactttttgtagagatgaggtttcaccatgtttcccaggatagtcttaaactcctgggctcagaacaatccacccgcctcagcttcccaaagtgctgagattacaggcatgagccaccactcccggcctggattgtgattttaaactcagagagctattgacagattcttctgaaaatgggttgtcctcatttgcattctccccactagtgtggcttctctctctgtagtctacactcatgccttccctcatgacttaaagaatatttt

SEQ ID NO: 12660 - DNA, 444 bp, Homo sapiens
cagatgtgcagtgtcttaagagaaatctaattaaggctatgttcttagactgaaagcttgaatttactcagcatcaagcctgcatcacttttatccctcctatccatttaatttaccattactagaatattttaaaaatgccttttgtggctgaaaactcaatgctgaaatgcttatgtattacacagaggcatgtttttcactgtaggaaatactatgttttcttttcttttctttttttttttgagacggagtttttgttctgttgcccaggctggaatgcaatggcacaatcttggctcactgcaacctctgcctcctaggttcaagcaattctcctgcctcaacctcctgactagctgggattacaggcgcccaccaccatgcccagctaattttttaatttttagtagagatgagtttttaccatgttggccaggctgg

SEQ ID NO: 12661 - DNA, 672 bp, Homo sapiens
  misc_feature (669)..(669): n is a, c, g, or t
atgattttaggagcgtgtctagaaaggctggacttatgcagctgccgttatcctatggggactgcaaatgttacttgttaatgcagtaaaatgttgaaggggtttgtagaagacactgttggcaacttacctgtatccgtcacttttaccatttcagtgtacacactaccgttttcagctgccagcatctgcacttcttgcctgagggctttctttgctgcttgactacagttttccactcccatggcagttggaagtgctggggaattcaagctccatcccacagcagctctaaacaataactggcaagactctgtgtctgaataccacagctccctcccatctggggtgagagaactctgaggcatgtagtttacactggctcccagagtccccccagcagaattctgctccagagataagcctgataacacatgcctctattggccaccttcccttccttgtctccctttcccactccccaaccaatgttttccttcacctcccagtaaattcctgtacacagatccttgtctccgggtctgcttctgggaaaactgaaactaagttagaattcttctgagatttttagataaggatgtctgctattctattacgattcagcattttactctaggtctttagctatgtactaaaacaagaaaaaanaaa

SEQ ID NO: 12662 - DNA, 353 bp, Homo sapiens
taccttctaaatattcctcaaatccatctacttttattcattcctatctctatcatcatctcttgcctggacttttgccatggcctcgctgtttgtctatctgagctcattctggcttcttgcttgttagttcctcaccctgcacccagagtgatcttttcaaaatatgtggttatgttataccctgcataaagcccttcatggcccttaagataaggcaaactccttaacatgcccaaaggcctggcatgatttggctcccatcaaacatatagcacactcatcattgctccagctccaccaatctttttatattgctctgttccttctgcctctaggtctttgcaagtggg

SEQ ID NO: 12663 - DNA, 304 bp, Homo sapiens
atttcctttttgaattgcatattcagccctttgcccattttttctgttggtatgtttgtttttattgttaatttgtaagaattttaaaaactcattttgaattatactattttctgactccagtataaatcagaagttttcagatacatttctaattttatcaactgtggaggattacaagtagaaatataagtgcaaattgaggatgctgctttaatggttccttctttagtgaggttttgaattactacatcatagtacttagggagtcttttggacatttactatcccctcctatgttctg

SEQ ID NO: 12664 - DNA, 411 bp, Homo sapiens
gagactacacctatgaaaacaatttctgctgaaatacccctccagagagctttctaactggagctttaaagttcaccaggcggagcaaagttgagcaaaggcagaaatgggaaggtattgcaaggaaatggaaaaagaggaaaggacaggataaaacctgaagacctggccaggcaaggcgacttatgcctgtaatcccagcactttgggaggccgaggcaggcggatctcctgaggtcaggagttcgagacttgccatggccaacatggtgaaaccttatctctacaaaaatacaaaaattagctgggcatgatggcaggtgcccataatcccagctattcaggaggctgaggtgggagaatcacttgaatccaggaggtggaggttacagtgagctgagattgtgccat

SEQ ID NO: 12665 - DNA, 287 bp, Homo sapiens
atattgatcagaatgaccctctggaagaggaagcaaaatgccacatgtgagaggctttgatgtatgattgggccagtactatggcaaattaattgagacaaagctaagttttccagaaaaggcttacttagctcagtatgtatcatttgctacagtgaaagtctgcatgcaacattccccaatgagtatatattgtttgctagtaaaaattcatttcattcaacaaatatttattgagtgtctacttttgccaaatcttctaaaagcagtctgtggagtttcttatg

SEQ ID NO: 12666 - DNA, 386 bp, Homo sapiens
gcagtatgcgggcaccatcggcctcacccgagggacttcccaaacccctctttcaccccttatgacaaggtaacctttaaaccatttaaagcagggatccccaactccccaggcagcgaaccttagcggtcggtggctgttaggaaacctgcgacacagcaggaggtgactggcaggcaagcgagtactaccgcctgagctccgcttatctgacgtgacttagattctcataagagcgccaaacctatcgtgaactgcgcatgcgagggatctaccttgcgcacttctcctgagaatctgacgcctgatgatctgaggtaggacagcttcatcgccaaatcatccctgtctccccaaccccccacccatggaaaaattgccttccc

SEQ ID NO: 12667 - DNA, 437 bp, Homo sapiens
caagctcttgctctgttacccaggctggagtatggtggcacaatcatagctcaccacaaccttgaactcctgggcttaagagatcttcccacctcagcctcttgagtagctgagactacagggcacaccactttgcccagctaatttaaacaattttttgtagagacaggatcttactatgttgcccaggctggtctcaaactcctggcttcaaatgatcttcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcaaa

SEQ ID NO: 12668 - DNA, 794 bp, Homo sapiens
tgtccttatttaaaatctctggaagccccacttagtggcttccatccatgtctcatgggacagaactgaatcacatagccatcccttgctgtaagagagttggggaaagtattttaagctgggacatcccagccctgagtgaagtcagggatctgttaggaagaatggatgctaggtaggtaaatggcaatgtctgacaaagacatggtaggccagtctgaaaaatgtaaagctgggctgcgcgcggtggctcacgcctgaaatcccagcactttgggaggccgaggcgggcggatcctgaggtcaggagatcgagaccatcctggttaacgtggtgaaaccccgtctctactaaacatataaaaaattagccgggcttggtggcgggcgcctgtagtcccagctactgaggcaggagagtggcatgaacccgggaggcggagattgcagtgagccgagatcgcgccactgcactccagcctgggtgacaaggcaagactccgtctcaaaaaaaaaaagaaaaatataaagctggatctatacctcactccttataccaaagtacattacccttgtatcaaatattttaaaaactggaataagcttttcatataatctttgagaagatggggctttcaaagcgttaaatgaaacacagaagccatggccaggcacggtggctcatgcctgtaatcccagctctcagggaggcaagaggcaggagcatagcttgagcccaggcgttcaagacctgcctgggcaatatagcgagaccccgttctccccaaaaagga

SEQ ID NO: 12669 - DNA, 452 bp, Homo sapiens
ttgcaaacagtccataagctcccagattgaggctgcaaacccagacatggtggtttcttggacttttccatgaaccccagcttctgctccagtgcctcaggctagagtcagtggggactattttgtctgattctctgactataaacttccaggccttcactctcccagccttgatgttcgtgtaagctccaaatcctatacgaaatgccttcattcattcctccatgatctgcagtggttgggttaggaaaacagagtgacacgggaggcgtgaggatggtatcctgatctttcactctcctctctcctacacagaagaacctggcccatagaaggaagtgtttcagaagattctggtgaggcatggaggtaagcaccaaaacagccccctctacacctcaacgcacacacatgcatgctcattctctctctctctctctctcatcttcctc

SEQ ID NO: 12670 - DNA, 561 bp, Homo sapiens
atctactcctagaccggcaaattatcctgttacaataaaatactaaaatgcttaaattctctggttttaaaggttatttgctttaaagcataagaaaccaactacagctaacttaagaaaaaataaatttattataagaacatagaatgactggaagggtagcaaaccttcagggactaggacgcagttacttgtgctaagaaccatctgattaggaaactggatccttctttgttcttctactcaagttcaaatttcagaaagaaagcattttctagctaacttgagtcacattttttgctcccctcattttttaagggacagggtcttaccctgtcacccaggctggggtgcagtggcactatcacaactcatgcagcctcgaactcctggactcaaggaatcctcctgccttagcctcctgagcagctggcactacaggtgtaagctaccacacctagctaattttttcaattttcgtagagacaggatctcgctatgttgctcaggctggtctgaaactcctggtctcaaatgatcttcccacctggacttcccaaa

SEQ ID NO: 12671 - DNA, 619 bp, Homo sapiens
gaaacagaagcaaaaacaccaataatgagcactgaatacatttatgtttcgggattacaattaaaacaactattggaattatggttgcgaaacaaaacaaatgctataaaccattataaagcagaaactgtaaaacccaatgaaggtaagaatgcgttaagtatcttgattttctcatttttttgtagttgaaggccaagaaaagatacgtttaaagtctgtagcccagctattagggatacaaataagtgtgaagttatacaagaaccctctagagagaggctgttggccagaggtagcatctgcttctttggtggtcttggagcttgagagtgttgatgtcatttggtgtgtggggaccaaagataatgagcaaactgtaaaatgcttgactgtcttggacaaagacgatttttctcatacaaacactcacagtgtccctacggaacagtaaagcagtagaactaataatagcaataaccagcccaaattgaatggaggagagaagagagaggatttgggagaaagtggttttgtcattactcttggtgaagagtcaattgattatatccgaagaaatgtaggattgaataaattatatacaaatatgagtgttctt

SEQ ID NO: 12672 - DNA, 686 bp, Homo sapiens
tggctgtcagttacttaaccacagaaaatcactgaaatgatgactggagaaaacatcaaaagtgtgctaaccaatagcactttttgtgatgatgaaaatattctgtatctgtgtcctccaagacagccactagccacatgtggttaagaagtcttttaaaatggccgagcatggtggcttatgcctgtaatcccagcactatgggaggttgaggcaggtggatcacctgaggtcaggagttcgagaccagcctggccagcatggtgaaaccccttctctactaaaaatacaaaaattagtcaggcatggtgtcacttgggaggctgagagaggagaatctcttgaacccaggaggcggaggttgcagtgagccaagatcgtgccggtgtactccagcctggacgacaagagtgaagacttcgtctcaaaaaaggaaaaagaaaaaaataaatctttaaaaataactagttgctgggtgtggtggctcacgcctataatcccagcactttgggagtccaaggtggaaagatttcttgagctcaggaatttgagaccagcctgggcaacaaagcaagacctcatctctgctaagaataagagaaaattagctaggcatggtggcagatgcctgtagtcccagttagtcaggaggcagaggtgggaggattgattgagcccaggagagc

SEQ ID NO: 12673 - DNA, 400 bp, Homo sapiens
tgtagttttccattcccctagtggccaccaggatgtgagctgtaccttcacctagcctgcccttaagtcagctcctctaccaactctaccttgctgtttcagattggtaggctgattaaaactctctaaagccagaggaggcctgcattccaccctcagctgagtgtgagccccgtgtgacctaggaagtcagcagcacagactttggggccagatagtctggtggaaccccagcccctgccattgatgttatgtacatcctgggacgtgttacttaccctctctgttcttcagttttctcctctgtgaaatggggagaaatagcacctactgcatagtggctgtgaggattaggtgaattagtatgtgagaacatttcaaacagtccaggaagcactat

SEQ ID NO: 12674 - DNA, 420 bp, Homo sapiens
gcctggccttaacctagggacataaagtcacagtagctctataggtgtttaaacacatagttctacatgtatctggttagttgaacccttctttttttttttaaattcatggaatggctgacttatttatttcatgtaacataatcttgaaaatacaaagtactctccctcctattttctagtccagtgaaggtgatcactttcctctttcatttaccttggttacttgtttcctgccctgaggtgaggctacttgtagggctgattaaggtgagatattttctcctttttgaggctctacttatgagctagaataataaaaattcaagaattgtgccgaattttcttttgttgatgactgtgatttagtctgttatgtaactacaatgtataatttacacatcctgaagatcatcagtc

SEQ ID NO: 12675 - DNA, 557 bp, Homo sapiens
agaacccagcaggcaataaaacacaaattgcatttacaaattaagtgcccataccatacttatggggttagaaaagcaaataccagtactatattttgttgaatactaataactaaaaatccacactataaaacaaataataaatgaattccagtagagtgtatgcaatcaaaagcaacaatattagtaaaacctcgtacaaaggaaacagtaaaatcctataaatgtacgtgaattctcttccaggtaacctgaatatttgtgaaactcacctctttgctgtgatgtattggggatcacactttgtcatcagggcaatattgctattctcctactattgtccattgaatgcagatggcagatttgttagttgaattttctattgcagtagcattgcttattttaagaatatttttagtagctactaagtgactataagttaccacggctcaccccagactcaaagcaagttttttgtgggcggggggggggggttgggggtggaggtgggaattggggtggggagttaagtggatacagtttatgtgcagacaaaa

SEQ ID NO: 12676 - DNA, 2161 bp, Homo sapiens
tgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttctttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagcgtaaactcagggttccctgagctatatgcacactcagacctctttgctttaccagtggtgtttgtgagttgctcagtagtaaaaactggcccttacctgacagagccctggtttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgtttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgtttatttgaatggggaaaataccctttaaattatgacggacatccactagagatgggttgaggattttccaagcgtgtaataatgatgtttttcctaacatgacagatgagtagtaaatgttgatatatcctatacatgacagtgtgagacttgttcattgaagataatattgacgatgtaaaatgcatttgaaagtctgatgggtttacaataaaagatattaagaatgttatcttaaagaaaggaagaaaaatgcggggataagaaggggggggcaaacacggactcgaagggcacaggacataggaggtccgaaccaaggttctggaacaaggggaaacacgcggacccaaaggaacgatcattggaaaccaggtacaggtagaacgacaaggggcaaagaggcaaagacgaacgggcgcaggacgacacatggaaaacggg

SEQ ID NO: 12677 - DNA, 1433 bp, Homo sapiens
cgtgatgctgcggcgttctagaggatcccgccactgacagagccctggtttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgtttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgtttatttgaatggggaaaataccctttaaattatgacggacatccactagagatgggttgaggattttccaagcgtgtaataatgatgtttttcctaacatgacagatgagtagtaaatgttgatatatcctatacatgacagtgtgagacttgttcattgaagataatattgacgatgtaaaatgcatttgaaagtctgatgggtttacaataaaagatattaagaatgttatcttaaagaaaggaagaaaaatgcggggataagaaggggggggcaaacacggactcgaagggcacaggacataggaggtccgaaccaaggttctggaacaaggggaaacacgcggacccaaaggaacgatcattggaaaccaggtacaggtagaacgacaaggggcaaagaggcaaagacgaacgggcgcaggacgacacatggaaaacggg

SEQ ID NO: 12678 - DNA, 503 bp, Homo sapiens
  misc_feature (473)..(473): n is a, c, g, or t
  misc_feature (502)..(502): n is a, c, g, or t
cactttatttacatgtttgtctcttattaaatcagctccctatgggtaggaaccttgtcttaattatccttgaatcctcagcatttttcacagggcatggaacacagtagacatttaataaacatttactgactaaatctgagaggaagaggatcctctctcaatatcagaaaactacttgccacacgacagttcggatcttagtccacttagtctatcttagtcagcttgggctgctataacaaaataccatacactgggtggcttacacaacagaaacttacttctattaaaggttggaagttcgagatcaggatgccagcattgttgggctctggtgaagtctctctccctgggcttgccaatggccacattctcaccctctcactcatgtgtcatcacttgatgccgagagagagcaagcaagctctctggtgtctcttcttataagggtactctaatcacagcatgangggcctaccctcatgacctcatccaaatng

SEQ ID NO: 12679 - DNA, 542 bp, Homo sapiens
tcttaggctgctactgagctcttgaggaaacaacagcggccagaggagcttcctgaaagcgtaactgattcatttatgcatactgcaggcagttatcactatcctgagagtcatcctattggaaatgttgataaggaatttgttcttgactttagctgcagtcatcagtgacaccacctcagctctggatggcacttaagtcagcctcaattcattggccagggtggttatgggtgatagaattgctcttcctctttgtgggccaaattggagtcagtgcaatcactaatacatcccactgtgactggattaatgtctcagaccgagtacagggtcaatacagaaacttgagaatgccacttggctttctaaggtagatcctgatggtttatgattgttggtttttttttcctaccttgttggatacaggcccttggatatggctgaagtcagtactgattggtcttatcctgttacatagagttctgttgatagtacctttaattaaatgtaataaaatactttgaatggacctggttcca

SEQ ID NO: 12680 - DNA, 2478 bp, Homo sapiens
cgacctcctccccgcacactttgaacgccgcgcctgaggccagctggcacatgcgcatgcgtgtctctggtgcctgctctccccaccaaagcaagaagcggcgggtacttgaagcggagtgagccggaagtcgctttgcctgcccatttccacgctgtaccggcggaaattcaagcactggaagagaggttccggggctgggctggcctgactgaaggcggcggaatggagacgcggaccgaggacgggggcctcacccgccgccccacgctggcctcttcttgggatgttgcaggcggggccctgacccacagcctcctcctcacccgggccggtctcggccccggtgacttcgactgggaggagctgctggcaccgcctgctccaggtcaggatctggtgattttgaagagaaaccacaacaacaaagatgaaaacccctgcttcctttacctgaggtgtggccctgatggaggtgaagaaatcgcttctattggcattttaagttcagcaagaaatatggaagtgtacttaggagaggagtactgtggaaccagtaggggcaagaatgtttgtactgtcctggatgacagtgaacatgaaaagatcattttgtataaaaaaaatctaaaattggagtcctccacacatgcttgtaaaataaagttgctctcctttggcgaaaggcagtgtgtgttcatcagtaaagttgtggtacacatgagatcagtttttgcaaattcttcaacaagctctcctgctctaggatcaaggatagaccttgacaaggtccaaaccataatggagtccatggggtcaaagttatctcctggagctcagcagttgatggatatggttaggtgtcagcagcggaattgtattcccattggagagcagcttcagtcggtgttgggcaattctggatacaagcatatgattggactacaatcctcatctaccttaggaaccttaaacaagtcgtcctccacaccttttccttttagaactggattgacatctgggaacgtgactgaaaacttacaaacttacattgataaaagtacacaactgcctggtggagagaattctaccaagcttgatgagtgtaaagttatgcctcaaaaccattcctttcttgaaaatgatcttaaaaatgcaatggcctctttcttaccaaagaaagtaagtgacaactcaaatatacccaactccgagttgctgccttttctccagaatttatgtagtcaagttaatcatctccatgtgggaaataagaccgagtgtcaggaaaacatcaccaagcatggtgaacgcattcttggtgttggaatggaagagcaatctatttgctcctacttggaaaagattctttctaaaaatatggaactgatggaaaagaaacttatggattacattgatcagcgaatacatgaactccaggagcacattgatgataagattgctttgttactggatttgctgcaaaatcctaactccccgcccactgggatacctctaagacattatgactctggagaaagactttcaaatggagaaagataagctctcaacataaacagtgtactgcagatatttattacatatttattacaaagccaaaacccaaaaatatttataaaaagcaagtatttaatgtcctttgagggatcattgtcttacacaaagtgacctcagttttcgtttttactacacttgttattttaaatccagtactgtacactgagttaatatgatacagtcaaattatttttgctcacgatatttttcagtcttacagaaatgtatgtatatttgtgttaagagtttaaaatgcttgaggatttctaatacagttcattagtttgtattgtatatgtgtttaagtataatttttatttatacaaagatcttatagtcttagaagtatgaaaaataatgcttaagagtatttgatttttttctttttctaattatcttggaaaattggatacttaagacttggagcctttacttcagattaccagtttacattttgtattgcttgtgtgagataatgaataagatgtgatatttggcatgtgtaaacttagttcactctggggttgttaatattatttgtttcattacagagtagctgtaggtaggaaagtaaacatcagaactagcctagtccttgttacgattagtactttggatttgatttttcctgtaaaacagatgcagtcatcttgtttgacctcagtaaccccagacagtttaagaaaacctctccttttgagctgatacaggttttttccccagaatccttttctggcatgtttattgtatgaaataatgaggctctccatggaaggatgaacacatatgagtcaagggattgcaattctctctgatagacttagttttcagaccttataactattgtatatgcattgaagggtgatatatttgcatataaaaataaatgcacctgctctg

SEQ ID NO: 12681 - DNA, 758 bp, Homo sapiens
agacggagtcttatcacccaggctggagtgcagttgcgcaatctcagctcactgcagcctctgtctcccgggttcaagcaatcctcccagaatggaagagcaatctatttgctcctacttggaaaagattctttctaaaaatatggaactgatggaaaagaaacttatggattacattgatcagcgaatacatgaactccaggagcacattgatgataagattgctttgttactggatttgctgcaaaatcctaactccccgcccactgggatacctctaagacattatgactctggagaaagactttcaaatggagaaagataagctctcaacataaacagtaaacaggatgcctgtgatgaaaagttccttttgtaaccagtccagaggagactggttacaaccacgatagctgaccaaacgactttaaaaagacctcagcctttttataatcttatttctgtgctaaataacgctcctgctagctccatgacagttgacaatcgccatgacagtgaccagaagaagccatgaaaggacaaaaaggaaggcagcactctggttttaggaagttcactgcccatttctgaaaaatccaggaatattcctccctttgcttgaatgtgaaacacctttattagaaaaattatattttaaccccctcactcctcattagttgaaaagttgatttgtgagccatactcctgcttctcaattcagtggcgattgaataaaacctgcagtgtttgtcactctt

SEQ ID NO: 12682 - DNA, 3088 bp, Homo sapiens
cgacctcctccccgcacactttgaacgccgcgcctgaggccagctggcacatgcgcatgcgtgtctctggtgcctgctctccccaccaaagcaagaagcggcgggtacttgaagcggagtgagccggaagtcgctttgcctgcccatttccacgctgtaccggcggaaattcaagcactggaagagaggttccggggctgggctggcctgactgaaggcggcggaatggagacgcggaccgaggacgggggcctcacccgccgccccacgctggcctcttcttgggatgttgcaggcggggccctgacccacagcctcctcctcacccgggccggtctcggccccggtgacttcgactgggaggagctgctggcaccgcctgctccaggtcaggatctggtgattttgaagagaaaccacaacaacaaagatgaaaacccctgcttcctttacctgaggtgtggccctgatggaggtgaagaaatcgcttctattggcattttaagttcagcaagaaatatggaagtgtacttaggagaggagtactgtggaaccagtaggggcaagaatgtttgtactgtcctggatgacagtgaacatgaaaagatcattttgtataaaaaaaatctaaaattggagtcctccacacatgcttgtaaaataaagttgctctcctttggcgaaaggcagtgtgtgttcatcagtaaagttgtggtacacatgagatcagtttttgcaaattcttcaacaagctctcctgctctaggatcaaggatagaccttgacaaggtccaaaccataatggagtccatggggtcaaagttatctcctggagctcagcagttgatggatatggttaggtgtcagcagcggaattgtattcccattggagagcagcttcagtcggtgttgggcaattctggatacaagcatatgattggactacaatcctcatctaccttaggaaccttaaacaagtcgtcctccacaccttttccttttagaactggattgacatctgggaacgtgactgaaaacttacaaacttacattgataaaagtacacaactgcctggtggagagaattctaccaagcttgatgagtgtaaagttatgcctcaaaaccattcctttcttgaaaatgatcttaaaaatgcaatggcctctttcttaccaaagaaagtaagtgacaactcaaatatacccaactccgagttgctgccttttctccagaatttatgtagtcaagttaatcatctccatgtgggaaataagaccgagtgtcaggaaaacatcaccaagcatggtgaacgcattcttggtgttggaatggaagagcaatctatttgctcctacttggaaaagattctttctaaaaatatggaactgatggaaaagaaacttatggattacattgatcagcgaatacatgaactccaggagcacattgatgataagattgctttgttactggatttgctgcaaaatcctaactccccgcccactgggatacctctaagacattatgactctggagaaagactttcaaatggagaaagataagctctcaacataaacagtgtactgcagatatttattacatatttattacaaagccaaaacccaaaaatatttataaaaagcaagtatttaatgtcctttgagggatcattgtcttacacaaagtgacctcagttttcgtttttactacacttgttattttaaatccagtactgtacactgagttaatatgatacagtcaaattatttttgctcacgatatttttcagtcttacagaaatgtatgtatatttgtgttaagagtttaaaatgcttgaggatttctaatacagttcattagtttgtattgtatatgtgtttaagtataatttttatttatacaaagatcttatagtcttagaagtatgaaaaataatgcttaagagtatttgatttttttctttttctaattatcttggaaaattggatacttaagacttggagcctttacttcagattaccagtttacattttgtattgcttgtgtgagataatgaataagatgtgatatttggcatgtgtaaacttagttcactctggggttgttaatattatttgtttcattacagagtagctgtaggtaggaaagtaaacatcagaactagcctagtccttgttacgattagtactttggatttgatttttcctgtaaaacagatgcagtcatcttgtttgacctcagtaaccccagacagtttaagaaaacctctccttttgagctgatacaggttttttccccagaatccttttctggcatgtttattgtatgaaataatgaggctctccatggaaggatgaacacatatgagtcaagggattgcaattctctctgatagacttagttttcagaccttataactattgtatatgcattgaagggtgatatatttgcatataaaaataaatgcacctgctctggaactacttgtctttagttagtagaactgttttatttcaactaatctttacttcaaatgtcttattttttagaaaaagggtatctcatactcatttaatattttggcaaatttcttctttaaaaatgttacctgatgtaattcctgcgtgacatagctgaatttttaccctgccctaactctgcttatctttaagaaacaggatgcctgtgatgaaaagttccttttgtaaccagtccagaggagactggttacaaccacgatagctgaccaaacgactttaaaaagacctcagcctttttataatcttatttctgtgctaaataacgctcctgctagctccatgacagttgacaatcgccatgacagtgaccagaagaagccatgaaaggacaaaaaggaaggcagcactctggttttaggaagttcactgcccatttctgaaaaatccaggaatattcctccctttgcttgaatgtgaaacacctttattagaaaaattatattttaaccccctcactcctcattagttgaaaagttgatttgtgagccatactcctgcttctcaattcagtggcgattgaataaaacctgcagtgtttgtcactctt

SEQ ID NO: 12683 - DNA, 349 bp, Homo sapiens
ttgtaagaagacagagcacagttgtggagacaaatctcagcaatatatgttggctgcttgttttataagcttggttgtttttgttattagggaaaatttacacatttttaaaaatgtatttttagaatggaagagcaatctatttgctcctacttggaaaagattctttctaaaaatatggaactgatggaaaagaaacttatggattacattgatcagcgaatacatgaactccaggagcacattgatgataagattgctttgttactggatttgctgcaaaatcctaactccccgcccactgggatacctctaagacattatgactctggagaaagactttcaaatg

SEQ ID NO: 12684 - DNA, 454 bp, Homo sapiens
gcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgcc

SEQ ID NO: 12685 - DNA, 445 bp, Homo sapiens
tgactcaacacagccattcccctagaagttacagtgtcacccttcagagatctaccccgtgtgcacacatagagaagaggcttaggttgttagagtcagcatgttaaatcatttcctgaaatgcgactgtaactagaacccagctgacttcccccacagccattcttacctattttattactgtctggcataattaccagcatgtaaactccaagaaggtgcttcatcttcttccagtgcctagcataggcatagggtgcatagtgatggctttaaagtggaagggattccaaggttcgcctcatttagggatggagctattgttataatcagttttctgaaatcattgctgacttcctctcacatttcacaggaagctagacttcttaaagcttaaggtttccttggtgggttttatttaaattgaattaaaatatttatttta

SEQ ID NO: 12686 - DNA, 326 bp, Homo sapiens
cttaatgtgggaaccgtaaaagcaaatgtgaatatggcatttcaagactacataactgagaagcaagccaaactataaaataaattaattcctgtagaataaatacagagaaagcaaatgtaactgtaaaaatggagcaaaacatgttgcaaaatcctgtgaatgtgaatagatttctatatagccatagaacttgtagattaacaaatggttcaagaagaactggtacaatggagacagaaaaatgacttccaatgttacaactgcttatagaaaagataaatattcacttatgtacaacaagcaataaaaaaggaagacgtcta

SEQ ID NO: 12687 - DNA, 381 bp, Homo sapiens
aagaaacctagagcttctctggttctagttttttccaaaggctcattttccagcttttccttccattctgagagctatacccatagcttcccattaattcctttattgtttggttaatttggcctaatactgtgactcagtctctgtcacttgccaccctagaaccctagccagcacagaaatgacggagtgaaaccacctccacacaaaccagtgctgcttcctctcttcacagttgcagattctgtctctagtggcagcattaagggagattgtgtcatcaagcctgctttgctctaagatgctgactttaacagattagaaatgttccccgcacagcccacgcttctgctaataaatgattccatatctatcatgaat

SEQ ID NO: 12688 - DNA, 526 bp, Homo sapiens
ccctgatggtcccatccccactccagggatcacgtgacttggcaaaccaagatgggggatgatacccccagagcctggctccaaggcctcctgaagaggccatccttgcaacagaggaagggaaggcaggaaggccggttctgctcaaatgggaccccaggagaccaaagccctgagccgtgaatccagctcttccacttactactgtatggtgccaggcaaactgcacaacctggagtttttagtaaggttcctttgggatgcttgtcagcagcgaatacaatgtctgttcaacgtttgtcatcagctctcacctgggagaagccttgttactgtggggaaagggaaccaagtgaagggaacggacatccgatgagagcctgccatgtgccaggcaccattctaggtgctttgcattcctaatctcatcataatcccacaaccacctaacctttatctccattttacagagaaatcaaggacaggaaccaagtctgaaatagaaccccaagcagaatctcttttc

SEQ ID NO: 12689 - DNA, 222 bp, Homo sapiens
tttcttaacttgggtgagatgagttgtaattcaggtgtttttatgtcctcaaactatttcaaactcagagatgatcggatgacctttttgaacatgactattaatatttttaaaaacagaaacggttttccttctttgaagaaatggtacaaaaggggaagattttcattgacttttttgggaacatgttcaaatagttaagaacctaaggttccagttgca

SEQ ID NO: 12690 - DNA, 454 bp, Homo sapiens
aaaacaaacaaaacgaaaactataatagcgttagctgtaattcattaaatatttccatggtgctgggtagtgtgagaggcaatttataaatgtccagctctgataacaaccaggaaaggcaggtagtattattcctattttatagatgaaaaagttgaggctctggaaaatgaatgatcttgtgggccgggcatggtggcttatgcctgtaatcccagcactttgggaggctgaagcgggtggatcacttgaggtcaggagttccacacaagcctgccaacatagtgaaaccccatctctactaaaaatacaaaaatcagttgggcatggtggcacgtgcctgtagtcccaattactcaggaggctgaggcaggagaatcgcttgaacctgggaagtgaagattgcagtgagccgagatcgtatcactggactccagcctgggcgacagtacga

SEQ ID NO: 12691 - DNA, 516 bp, Homo sapiens
catacctgaccttctccatttcctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtc

SEQ ID NO: 12692 - DNA, 1553 bp, Homo sapiens
accacaccctggcaccgtcatttcccactccgtggcgatgctgatcctcataggctccctggactctgatcctggaacccctccctctgcgccgcagctggacgccacctccgacggacacagccagccccttcctgctgccaagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtc

SEQ ID NO: 12693 - DNA, 363 bp, Homo sapiens
gatgctgatcctcataggctccctggactctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaggattttctttaaattgagaggcaccaggcagtaacttccatgatgacactgacgcctatacctgagctctaggctgcctggagggaaggaacaggcccatgggaagaagggggttttaaaaacatgtcttcaactcagcag

SEQ ID NO: 12694 - DNA, 208 bp, Homo sapiens
gactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctga

SEQ ID NO: 12695 - DNA, 382 bp, Homo sapiens
aaggcaagtctgttagtgatgaacttcctcagcttttgtcagggaaatttttatgtttccttcatttttaaagggcagttttgccaggtatagtgttcttagatagcattctttttccctttcatccctttgaatatgtcatgttactgccttctggcttgcaaagtttgagctgaaaaagtcaattgatagtttaatagggattcccttgtttgtaatgagtcattttcttcttgcttctttaaaaattctctttttttgaattaaaaaaaagaataaaaaagacttaaaaattctctttttttgaataaagacttaaactgtctttattctttattactattattattttcttcctccgactgggtgatttcacgtggcc

SEQ ID NO: 12696 - DNA, 1256 bp, Homo sapiens
gtgctaagagtagaattcccatcagaaaggaacatttctattttctgtccttatctcttggtcaaaacttcaaaacttgctattagtgtggtattttaacacttttttaaataaaaggctctggaaagatctctttaaaaatagaacatggattgcctgtgttagaaaaggataaagataggattttagatgttctttgcattatctgagctgaggttaccaccccgaggagaatgtgccctatttttagaaacataacttggttgtttttcccccccgatacatggtctctcactgtcgcccaggctggactgcagtggcgcgatcttgtctcgttgctacctccacctcctaggctcaagcaattctcctgcctcagcctcttgagtagctgggattacaggcacccaccaccatgcccggctaatttttgtatttttagtagagatgggatttcaccacattggtcaggctggtctcctgacctcaagtgatttgcccgccttggtctcccaaagtgctgggattacaggtgtgagccaccatgcccattatgaatttaggatattcacaggtcatgaagaatatgcatttgaacaattccagtgaaaattttacaagctgacaatacagaaaaatatgccatgtttccccactccattttttttctttattggtgaactataaatatgtgggaatgctatggtataagatgaagagaattcagatataaaaatgaaaacttcttgatagcctttcatgccttataacccttgggttgtgggtggcaggcgatgacgggcagagagataatttaaatacaaaattaggatctagaacttaggcaagaatttattggctggagatataacttagagtaatcactgttataagcaaaatcctggaagtagccaaacatgtagggagaaagtacacaggataggaaagatgagaagggatagaatcttggagacgctgacgtctgaggacaagctatgccttcaagaggcataaggcaaaaatgcatgacccaatgaacccagccctgctgtgaaaggcctcctttcactgagtcatatctgtgggctcctgcactttgttccctggcttcttgccttaattcccttggatttcaggacttttttgttagggaatcacaatctgtgcctgacttcccatggatcccccaagatagatcttgctcagcgaagacatgggcaataaaagcttaaaaggaatggtcagagttaaaaaaa

SEQ ID NO: 12697 - DNA, 330 bp, Homo sapiens
gtgctaagagtagaattcccatcagaaaggaacatttctattttctgtccttatctcttggtcaaaacttcaaaacttgctattagtgtggtattttaacacttttttaaataaaaggctctggaaagatctctttaaaaatagaacatggattgcctgtgttagaaaaggataaagataggattttagatgttctttgcattatctgagctgaggcaggagaatggcgtgaacccgggaggcagaggttgcagtgagctgagatcgcgccactgcactccagcctgggcgacagagcgagactccatctcaaaaaaaaaaagtcgacgc

SEQ ID NO: 12698 - DNA, 224 bp, Homo sapiens
aatttcacttttgtggatagttaagtataacatggtttagtataaaatctggtcttcctctagatttctaagtcactagaagaatttcttggcaaattgattgttcaaggccagttttgttagttgtaaggtggaagccaccccaatcctctcccagtgtttcataggcattttcagacctggatgctattatagttcctcctctagttttccagtagagaatt

SEQ ID NO: 12699 - DNA, 435 bp, Homo sapiens
agtcttcatggttattaaatcatttcttcccaggtcattctcatatcttaaaaagtagagaaagtagggctgagtgagtgaaagcgcctgttgccattgcattttcccaccatctgccactatgaggactcatcttggccctaatctcaccccaacttctgcagtaaaatacctgggctggccagtgattgaactttcctctcaaacattagctgacctttactgagttctttgtctcaaatcaccattactagcacctttgcgcacttcagtcttttctcatagggcctacatgatttaacaagtaaaattggggacccaaagtagaatgttttcagtaagaaatgaaggcgcctaggaaggggactttttatgtcctgtgtatttctcttctgtcactggcaataaaaagccctcaggaaaggtcacttgctt

SEQ ID NO: 12700 - DNA, 1087 bp, Homo sapiens
gcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgcaccctctgaaaa

SEQ ID NO: 12701 - DNA, 546 bp, Homo sapiens
tctctacaaaaaagcaaaaaataattagcctggcatggtggcacacacctgtagtcctagctactctggaggctacagtaagctgtgatggtgccactgtactccgcgacagagtgataccctgtctctaaaacaaaacaaaacccacaactaactggtcaccattggagtatttagtgaaccaattattctgagaactggtcagtaaagggaaagaattattcgtcctgtttttaactgaaccacttggtaatcaaatagtagattaaaggaaatgtctctttttatagaggtattctagctaataaatgaaggaacaataatagaatgagaatattaccatttggtgacctctcataaattaatggagctaggcattactcatcaacaattgctaatatctcaaaaggaaagacaaccagatgacaatgacatgtacctcctggcagttcataataccactgtgaagtagttttcctccctaccctcctagaagtactgaatgtgattaagcttttagattcaactaccaatttataggaatta

SEQ ID NO: 12702 - DNA, 822 bp, Homo sapiens
cattttcctaacccagcagagactgttaatggccccttaccctgggtgaagcacttacccttggaatagaactctaaaaagtatgcaaaatcttctttgtacagggtggtgagccgcctgccagtggaggacagcacccctcagcaccacccaccctcgttcagagcacaccgtgagccctcttcggccattctgtggtgttttaatattgcgatggtttatgggatgttttaagtgttgttcttgtgtttgttttcctttgactttctgagtttttcacatgcattaacttgcggtatttttctgttaaaatgttaaccgtccttcccctagcaaatttaaaaacagaaagacaatgttgtaccagttaccattccaggtttgagcatcacaagcttttgagcgcatggaactccataaactaacaaattacataaactaaagggggattttctttcttcttttgtttggtagaaaattatccttttctaaaaactgaacaatggcacaattgtttgctatgcgcacccgtccaggactgaaccatgcataggcaaaacgagtggagcacagcgtccagcccagtgtgtttccagttctgagtcagggtgatctgtggacgggaccccagcaccaggtctacgggtgccagatcagtagggcctgtgatctcctgtcagtgtcctcagctaatgtgaacagtgttggtctgctggttagaaactagaataatgatattttcaggaaagaaatcagctcagctctccactcattgccaaatgtcacccaaaaagggtttagttttaaggagaaaaaaaaaaa

SEQ ID NO: 12703 - DNA, 318 bp, Homo sapiens
catcacacctagctaaggatgcatgtgttttgataaacagtatgttctcaacctttgtttgaggaagagctagtcacaaaaatcaaataatcacatgtctgaaagaagtcctaaggttcagtctaacctctcccttgtaatgatgatgaaagcaaacccagagaggttaaacagtggcctgcagtgcggcttaactccaacgggagtgccatcctttctcagcacttaccacatctcccttctatactctaggcacctggtgggcaggctctcctttgcctgtatacagctggccttcagtaaatgtgtataagtcag

SEQ ID NO: 12704 - DNA, 268 bp, Homo sapiens
cgcaatattggctcagtgcagtctccgcctcccgggttcaagccattctcctgcctcagcctcccaagtagctgggactacaggtgtgcgccactcagctctaaattttagaccttgtaaatgctggtcaagaaagagaacaaaggccaggtgcagtggctcacgcttgtaatcccagcactttgggaggctaaggcaagcagattgcttgagcccaggagttcaaaacaagcctgggcaacatcatgagaccttgtctctactagta

SEQ ID NO: 12705 - DNA, 1874 bp, Homo sapiens
caaaatactaagatgaagagttaaggttcgttctcattacaaatcgagttcagcgtgtgtgtgtgtgtgtgtgtgtgtgtgtgtgtgtgtgtaatctttagtggctttaaagaataatattgccatttgtctactttgcaaataaagataacagaacacctttaaaatatatgtatgtgtacatatgtgtgtgtagatatagagagagagagatacggagagacagacagacagagagagagacagagagagagatgctttcccaagaggaaatgcatatgtaccttgatttaagcaaaactgataacagaaaattgaacttaatgaaagaaaaaagtctggatatggttactcactttacatagagtaagatttttaaaactaattttgcttagtagttaattttacaaaaatgaagagaaacaccctttaagtgtactcgtaatttaaaacacctttgaaatgtaattgtccaaatgtaatgctgctatgtatattatttgggttccagatttttccctttaaaattctcaaaacactcagtgtccttacaactgcagctaaaatggttaatcattctggcaagaaggtgacagtgtgtatattggaaaggcagacattcacatttgaaaatattttgcattattgttagctaaaatcaacctctccttgaatgtagatacaatatatggttttgcagtcaattctgaatggaaaaaaagaatcaagtctgaaatttatgtgaaatgtggcttcagatcatttgaacgatatgtagaaatctagatgaacatatcattagaggtgaaagcaaaatttgaaagcctaatgagatgaagcaacattatctctctctaatctgccaacaatattccctagattgtgttgccactgtattgattctgagtaatttggcttgtttatgcgtgatttaaatgcatgtggctgaatgcagtaatttttcaagttattgagtagtagagaattcaccactattcactgtctcccagagatgaacatataaaagaaaaaaaattctacttcatatatgtaagaataaagcaactaaatgatacaaaagtaaaaacttccaccagaatcagagatattccgacaagtgaattgtgagtctaacacgggaggacaaagctaggctcttgcaaggacagagcacacatggatcatgctgtatgagctcactttgtgtccctggaattagtgtttttttgtgtgtgatctaactggcaagtttaatgaatagccaaaatctatgttattcttgaggctcctaaaattatgtgtgaaccccaagttctgtctagtattatatccctaaaatgcttttaatagtggtatgttacaagtggcataagaagatcctgtttttaaatttgtcaggcattttattattcagtacataatatgtatagatctgagtgctgttttccttgcattgtctattatttttaccttgtctttcccctaagagaatttgaagaaaatcttcaccaatatttctagtgttgatggtaattaggaaaatagtagttgagagatgtaagaatagattgagaagagtgagtaaaatgggtgaaatgacaagtgggaaccatgtagctgagatgtatttgtttagatgaaaagtctacactggttcttaatgtgaaaatcaaaccatgtatctaccttaagaacaatgttgttgtttttaatttattgtagcgatttagtttttttcacgtaatatttctattttctttgcagattgtttttaatttaaattgtggaatttttacttctcaaaatgtattaagtactgtattttttgaaatcttatttttaaataaatattttttaaaaacgtaaaaaaaaat

SEQ ID NO: 12706 - DNA, 307 bp, Homo sapiens
ggaagtggtggatatggtcgcagagggttctaaaaacagcagaaaagggctacagctcttagcatgaagagatgcataggacaagatgggggaaggggtgaggagattccatacctttcctggtgtgcagctgtccagaaacctccacctgttcagctatctggaagtgccccaaacccagtccttttaagggttttatggaagctgcattatgtaggcacaactatggcggcggcctggttatagtagtagagggggctatggtggtggtggaccaggatatggaaaccaaggtggtggatatggt

SEQ ID NO: 12707 - DNA, 1070 bp, Homo sapiens
ggaagtggtggatatggtcgcagagggttctaaaaacagcagaaaagggctacagctcttagcatgaagagatgcataggacaagatgggggaaggggtgaggagattccatacctttcctggtgtgcagctgtccagaaacctccacctgttcagctatctggaagtgccccaaacccagtccttttaagggttttatggaagctgcattatgtaggcacaactgattaaaccactggccattggaaatcagtcagcctctctgccctccttggaggttgggagatgggacagaaagtcctaaccttctaatcctcccttggtttttcagtgaccagcccctaccctgaagctacctaagtgcgccagccaccaatcattagcatacaaaatgacaccactttggaaaggccaaagattttaggagttgtatgccaggaagggagttgaagaccaactatatatttcacaatatcacagctgcccagagtgagatcggcagcctttaaggtattcatccagctgaatgttcccacatgccctcaagtacttaccacccaactctgtagcagtgcacagtggacataaggtggtgttggcagtctcagtcctatttaatgatggccagagatacctcctggtcagccaaagccctggctgactgccaggcagttgcgcagtagctcttcctgtagtgaaactgttcttcttatcattgttgactaaactctgttggaagttgtctcactagccatatgagccacagctgtctctatcctgaatagcttaatgagccataggttgctgactcctggactgcaggaaccttttagttgcctctcgccacagttgaatttccttctggacctccatctctcttcatcacagttgtcaacacttgagccttctcccatgttacttcttatgcagtgtcccttctacttaactgtaagttttataaaagcagaaaaccgtcttattcagttttttgcttatgcagtaaacattgaataattgtcaaatgaataaataattgtcaaataaatgaatatattgaataccagcctttg

SEQ ID NO: 12708 - DNA, 112 bp, Homo sapiens
ggatattgcaagggatacagatgaagagatgcataggacaagatgggggaaggggtgaggagattccatacctttcctggtgtgcagctgtccagaaacctccacctgttca

SEQ ID NO: 12709 - DNA, 307 bp, Homo sapiens
ctctcctatttgacctctgaaagatattttagttataccaatgcccttcacctggggtttctcccagtccttagcttggctgatactgttctctcctggttctcctcctgctgtcctaagacactttaaggagcatttttatcatgggcaaatggaaataaaacacctatttcacagagtttttacatgaatgaaaaaggtcatatattcaaaaacacttggcaaatgtctgtttcattgaaagtgctcactggtttttattactcttgttatctctttccactccccatattctgtgctttaaaaa

SEQ ID NO: 12710 - DNA, 177 bp, Homo sapiens
gcggccgactactactactactgctcgaattcaagcttctaacgatgtacggggacatgaatgaaaaaggtcatatattcaaaaacacttggcaaatgtctgtttcattgaaagtgctcactggtttttattactcttgttatctctttccactccccatattctgtgctttaaaaa

SEQ ID NO: 12711 - DNA, 433 bp, Homo sapiens
tttcaaattatctaaatatggttttctttgtctttttctttcaactttgtcgaagtttgttttttcctaatttgtgcaattactaattatatgactcttggataagttactttacctttagaaatcaattttctgatttttacaatggaataacaatagtggctactttctgggttgttgtaaggattggatttttttaaatgcacatagcacatgcctagcatatagttatggatctgtagtaatagatgttagctatttttcttcttcttcttttttttttttattttttttgagatggagtttctctcttgtctcccaggctggaatgcagtggtgcgatcttggctcactgcaaactctgcctcccaggagaatcacttgaacccgggaggcggaggttgcagtgagccgacattgtgccactgcactc

SEQ ID NO: 12712 - DNA, 457 bp, Homo sapiens
gcaataaatgttaattacctacaggttgtgtttgctccatgttttcagcattgtgccggcactgaataaaaccaagcagctccagcttcttggggctgctctggccactagagccaggcagtcaactagctgctcttacactgcatacctgtgtctgagtactcatttcatccgtagccagggtctgcaggacacacccagcattctaggaatttaagcaaactaccatacccatgtaccagacttagctatgaaaaatgctcatcataaagttattaggatagtgaatgaatggaaatcttattgcccaatggagactggttcaataaacgatttccactgattgaataagtacgatacaaccatttaaaaatccaccaagatttcagaaatcaccactaaagaacttattaatgtaaccaaacaccacctgttcccaaaaacacctatagaaatt

SEQ ID NO: 12713 - DNA, 567 bp, Homo sapiens
agggttcctcccctttttagactatttagggtaacttctgggcattgctatgggtatttgtagactgtcatggtgctggtgaaagtgtcttttagcatgctaacacattataattagtgtacaacgaggagtgaggacaaccagacatcactttcatcaccatcttggttttggccggcttctttactgcatcctgttttatcatcaggtcattgtgacctatattttgtgccgacctgctatctcatcctgtgagtaacaatgccaaacctcctgggaatgcagcccagtaggtctcagccttattttacccagcccctattcaagatggtgttgctgtggtttcaacacctctgacataaccaacaaaaactgagtcaattccttggagtatgtagttgtgaaatttaatctaatctatccaagaatgagctccatggcctacttagttgcaacaaaaatagttaagaatgatgtaatataaaggcatgtacattatgcctctccttatatacatgatcatatatacttataatgcatcaactatttctggagggatacagcaaa

SEQ ID NO: 12714 - DNA, 4195 bp, Homo sapiens
tgcaactagagtttcttcaatattttctaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagaattttaaagttcaagtcctcagcttcctctggactcatactcaaaacaaggacccaattgtagcaaatgctgcatatagatccctggccaactttagtgcaggagaacacaccattcttcatctgcctgaaaagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacgaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtc

SEQ ID NO: 12715 - DNA, 1982 bp, Homo sapiens
tggtaatgactggattctggcactttatggttatagaaaccacttttatatattttgatttcctcccctaatgcttaattatctccatgtggacattatgatagagtgtcattgaaggtattaaaaatgtaattaattgcttaacagttatatcttgtgaaaacaatgtggaaatctttttacatttttaatttttggttcaaacaaacctaactaatcaaagagcagccacaaaaatcctcaaaatgcaaattagacacaataatgtacagctaccaattacagattttagtgtttttgtattccacagcaacaaactgccaagtcttaaaaaaaaagaagtcaactaaagcattctgttgttccctgagctctactgtatattctactggaagattttaagctctgtcatggacatatgactagaatcacaaattttttaaaaagtgttcagacaaggcaaatatctaactatgagctatagaagttaaatatattgagtatgtcagtgtttgcattttatttttggatggtatagaattttattagttttctataataatcattgcttatactggcttacagtgatttactgtattaacataagctttttatacagatctgagattgtatctaataagatgactagagtcatgaccatttagttaatctaaaaaatgaatagatttttaaaaaattaatttcagtggtcttttatgttatagagtgatggagtctaacaaaattttaaaatcttgtcacaaaaaaggatacagaaaagattttgcataatgttttattattatcctctctatgatcttttcgcttatcatttcagataagaccagaaattcccattcctgaagagttagatgacgatgaagatgttgaggatgtggatctttcagttcctggctcttgctatctcaaactgttgtcactcactccccctttggttttaccaggtgactcctatttggtagtagagaagctagcattttttagtggttcgatttgtctgattgtattcttttgtgataggtacatagtatagtttaaccttatgtgcttattttttaaccagaatgttaaatgcacccatctgttctattgaaacagcttgaggtagtatggtgtttaaatcatacgaaaaaacgttacatctgagtaggattgaacaagaaaactagtgtaaacaattgtgttcactgataattaaaattcatttaaaaggctaaatgtattccacaagatgaatttgcactggtactctaggtcattgatttaaacaatacttctttcttacataagccaagtgaaaagatcattagactattcagagatttactgagtagtttcattattatacatttattctttctatagagttatgccaaagatgttactgatatttatttcagagctataaattaatgcttttaaaagatggatcaaattgtatggtcattcagctttgatgtaaagcttatagggcctttatcttttaaaaagtaggctgggtatgatggctcacgcctgtaatcccaacactttgggaggctgagagaggcagattgcttgaggtcaggagttaaatacaaaattagcctggtgtggtggtgcatgctgtagttccagctatttgggtggctgaggcacaagaatcacttgaagctgggaggtggaggttgcagggagctgggatcatgccactgcattccagcctaggtgacagcctaggtgacagcctaggtgtctcaaaaaaaaaaaaaaaagtattctaatgcttatatgtggtaattattctatatgtatattgtgtttagaagtactcacttgcccctattactatatgccctacccaagaaatggtagacgataccatttgaaaaatatgtttgattgtggactgtgattaggaacttacattattttattttgaatgttattttctgatcattaaaaagttatttacaaattcc

SEQ ID NO: 12716 - DNA, 615 bp, Homo sapiens
tgcaactagagtttcttcaatattttctaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgaggtatgcatttggagctcagcacattgcctgcttcttcatgggaaagatgtgtgttataataacttttggaataaatattcctaatctgtt

SEQ ID NO: 12717 - DNA, 4373 bp, Homo sapiens
tggtaatgactggattctggcactttatggttatagaaaccacttttatatattttgatttcctcccctaatgcttaattatctccatgtggacattatgatagagtgtcattgaaggtattaaaaatgtaattaattgcttaacagttatatcttgtgaaaacaatgtggaaatctttttacatttttaatttttggttcaaacaaacctaactaatcaaagagcagccacaaaaatcctcaaaatgcaaattagacacaataatgtacagctaccaattacagattttagtgtttttgtattccacagcaacaaactgccaagtcttaaaaaaaaagaagtcaactaaagcattctgttgttccctgagctctactgtatattctactggaagattttaagctctgtcatggacatatgactagaatcacaaattttttaaaaagtgttcagacaaggcaaatatctaactatgagctatagaagttaaatatattgagtatgtcagtgtttgcattttatttttggatggtatagaattttattagttttctataataatcattgcttatactggcttacagtgatttactgtattaacataagctttttatacagatctgagattgtatctaataagatgactagagtcatgaccatttagttaatctaaaaaatgaatagatttttaaaaaattaatttcagtggtcttttatgttatagagtgatggagtctaacaaaattttaaaatcttgtcacaaaaaaggatacagaaaagattttgcataatgttttattattatcctctctatgatcttttcgcttatcatttcagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacgaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtc

SEQ ID NO: 12718 - DNA, 441 bp, Homo sapiens
gtaaaaaagcaattgtgtgaggcaggcataacttcaacagtttacactggtttaagttatttcatttgaggggtggtaccttattaagtcctatcttctaggcatagtcttatttgtttcttaagtttccttataataaaatatagtactcttaattaatggcttcatataggttggagtcttgttaggtgttgaccttttctatttgcttcacaggttgtttgcattcgctccacttggaatgctctctctccaaagctgagttgtgacacaagacctctcattctgaagacactgagtgaactattttctctagttccttccttaacggtcaatacaactgaatatgaggtatgcatttggagctcagcacattgcctgcttcttcatgggaaagatgtgtgttataataacttttggaataaatattcctaatctgtt

SEQ ID NO: 12719 - DNA, 717 bp, Homo sapiens
ggcccggcaataccaggtgatgctggggtgatgctgatgcccttccaaggttgagacctagtctctactctgatgtcagctctccgagagacactctggcctgctttgttcccttccctgtcccctccccggagcccggcggccggcgtgtctgcggctgtggaacctgcagggctgggtgcgcgcgcgatggggccgctgcctgctctgagcgacccggtgcgcgtgtggccgtggtgcggcgactgccaggacattgcttgaaaccaggctgtgtgctgccgtctatgccagatataccttcgatgctcctgtacagaagaggtgactgtctgtgcctagcttcctagagctggaagccgacacaagagtgtgggagaagcattcttcttggcctcaagctacttctgtaaattatgaccacccatcgcaaatcatactcagatcttggactgcccttcaggaaacgctatcgatgtactaacgtcctccttactggtgtgccagaatggtagcttttgacagagacgatgttcttcaacaaggcaagtcaaggtccaaggacggatttggcataaacttctgcggtctttaagtagaggcgatgaacagccactatactatttgtactcgcacaaagctggaaagcaagtaatggcgtccgcaaccgcttggtcggaatgggccattaggttcacaactccttgaatgatttaa

SEQ ID NO: 12720 - DNA, 1907 bp, Homo sapiens
ggcccggcaataccaggtgatgctggggtgatgctgatgcccttccaaggttgagacctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaggcttaactcatttaaggagctaccccagccatcattttctcagatggtgaaactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagcagttctcagccctgacagaggtgcttttccacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaa

SEQ ID NO: 12721 - DNA, 1522 bp, Homo sapiens
tcaggctggtacaccccgggggttctgggatctggcggtctgtgcgttctgctgcctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagcagttctcagccctgacagaggtgcttttccacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaa

SEQ ID NO: 12722 - DNA, 1225 bp, Homo sapiens
  misc_feature (1163)..(1163): n is a, c, g, or t
ggcccggcaataccaggtgatgctggggtgatgctgatgcccttccaaggttgagacctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaggcttaactcatttaaggagctaccccagccatcattttctcagatggtgaaactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagcagttctcagccctgacagaggtgcttttccacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatataggtgagtctgaattcncacttgagcctcttcaccttttttgtgttctcttgcaatcaggggcttggttgacgctcaca

SEQ ID NO: 12723 - DNA, 1937 bp, Homo sapiens
ggcccggcaataccaggtgatgctggggtgatgctgatgcccttccaaggttgagacctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaggcttaactcatttaaggagctaccccagccatcattttctcagatggtgaaactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagcagttctcagccctgacagaggtgcttttccacttcctaactgagccaaaagaggcccgggttttcactgttctctctctgcaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaa

SEQ ID NO: 12724 - DNA, 883 bp, Homo sapiens
ggcccggcaataccaggtgatgctggggtgatgctgatgcccttccaaggttgagacctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaggcttaactcatttaaggagctaccccagccatcattttctcagatggtgaaactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagcagttctcagccctgacagaggtgcttttccacttcctaactgagccaaaagaggtccctacttctggttttgccctgtcatgtcgtaacgaggtgggccttttgaggccattttagtttgagttcgagccaaccacctctgttggttagatgatgaataaaaaggttctgaagaaa

SEQ ID NO: 12725 - DNA, 409 bp, Homo sapiens
tgtcctctatactataataccattttttgtacatttgatgtagacacacccagaatagtctagtaggcagttggctacatgtatctgaagcttagaagagatatagactaaaaatatagatttggaagtcattagcatgtagtagtaattacctcatactctcttgctttgctttctagacctctgacccctccttctgtcatcatccatccaatcctccctcccaccatcattcaacaaatatttattgaacacctactatatgtaagacacttttctaagtgctggtgatacatcaggagacaaaaaagacaaaaattctgccttcgtggggtttatattctacaaattatatagttggttaaaaggtaataactccagtatgggcaacatggcaaaatcctgtctt

SEQ ID NO: 12726 - DNA, 499 bp, Homo sapiens
tccagaattaacttgctactaagattcttgcaaactgatggcttaggacttcttttcatcatcatcttggccactcccctcatgtctcttcctatgctgagtctcttttcctggtccctgtatatctcttcgttgcttatctttaattctcatttggggatcactttcttcagtaactttctgagaagacaatccatggcatgtggcctgcactggttattctctgtttgcttctccagtcttgttctccgtctttttcttcttgtgctgtgcccctggaggctgacatgtctgtattctatcacctggggtacacatcttccagtagggactggccaatgcgaggcaatggtagggagatcagagggcagtgggaagagacttgaaggaatcactgaaggattatcagagatttacatttagggcaggtggtgatgaccatcacagctgctgatttggatgtgctgtcttctctggaaaatcagcatggcccctggca

SEQ ID NO: 12727 - DNA, 923 bp, Homo sapiens
aaaaggctgtcacactgaccctttgcccttgctggcagaaggcagccatctcacccaaaaaggcagaggatccactgagctgttaacacttaagccatatgcagacagccaagctaaaagagcacccaaacacttcctctgggacttcaggggtcactggcacccctccccagatgttgctgcgggaccagtacagagttcactcctgctggtgcccgaaggcatttgcccgagctgccgtacccactcacctgtttgctccctccagcaaggggtggaacacagcagatttgagtgagtggagttggctgactccagtgctcatatactcccatatctgcccatgaaggggtcagggaaatatcctgcttcaaaaggacatcatcaagaaagtgaaaggaaaaaaatgaaaagacccacagaatgggaaaagatatttttaaagtacatatgtgataagaaaattatatctagaatgtgtaaagaagtcttacaactgaataataaaaatataaatattccaataagaagggaaaataggattttaacaggcctttctctaaagaagacatgcaaatggataattagcacatgaaaaaaagctgagggtcattagtcattagggaaatgcaaatcaaaaccatagcatacccgttcatacccataacaatacctaaagtaaaagggacagatgttagtgtctgtgaggttggagggaaactggaaccctcattcgctgcttgtgggaatgtgaaatggtgcagccactttgaaaatgagtctggcagttccttaaatgaataaacaagattaccataggactcaataatcccactcctaaatatatgcccaggaggaatgaaaacatgtttacacagaaacttatacatgaatatttatagcagcattatttataatagcca

SEQ ID NO: 12728 - DNA, 406 bp, Homo sapiens
gtgatggtgtgtgcctgtaaccccagcttctcaggaggctgaggcatgagaatagctgaggcatgagaagagcccagaaggcagaggttgcagtgagccgagatcccaccactgcactccagctggggaaacagagcaagactctgtctcaaaaaaattaaaaaaaataaaataaacttgtaaatattatacacttagcatataacccagccattctacttctgggttccccccaagagaaacacaagcttaggtccacacactaccctatacacaaatacgcagagaagctgcttacttaccatcaaatacatatgaggatatttacttccagttttgtttgaaataatatgaaactgaataaatcatgatataaccatacaatggaatgcagtgtaattattag

SEQ ID NO: 12729 - DNA, 92 bp, Homo sapiens
tgctgcataaaagtcaagttacgcttgcagaaaactttcctaactactaaaataaataaaaatcaaaagcttatagctgtattgcctacagg

SEQ ID NO: 12730 - DNA, 442 bp, Homo sapiens
tcctctcctactcccatcatctgggcctggaagattggaacagggctcccatctcaaccctcagggatggacaaatatagaataagagaagggaggaaagccatgggccctgtgaaaagactcagcagttctcataaaggaatcaacacaaatgtttcccttgagacaaacttcctaccagaatcaacagaaatctttagaaaaatctccaatttgtgtgcccattaagattcgagggggtatttattgtatacctgaaaaaggcatcctctgagattgaaaaagatgattttcagctgaaaagtgcaactgttacatttcagaaggcaatggaagcaggaaataacagattgaagacgcagaaaaatggagtggagtcctttaaaagatgggtaccaagaaaccccccataattcataagaaaagaataaaagatgaatgt

SEQ ID NO: 12731 - DNA, 2331 bp, Homo sapiens
caattctctaggttgcaaattgggaggattaggaacaagtaagagagttccatgcaggatggacaagaaagaaaagttttataccaaaaattgtatttcatggcattagggcagtctactggggtaaggcactatgcagtactaggcaattagaattctattcactagctatgtgcacaagcggctcctgacctggtcattttggctgtaaaactattcatgcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgtaaaaaaactca

SEQ ID NO: 12732 - DNA, 710 bp, Homo sapiens
caattctctaggttgcaaattgggaggattaggaacaagtaagagagttccatgcaggatggacaagaaagaaaagttttataccaaaaattgtatttcatggcattagggcagtctactggggtaaggcactatgcagtactaggcaattagaattctattcactagctatgtgcacaagcggctcctgacctggtcattttggctgtaaaactattcatgcctggacagtttttgacggtgcagtcttgctatatggtgtgagaaatggctgtaggaaacaacactcaacgaagttattccatcatcccgtgttttatatttgttgaggaggaagcaaccctcaaagtgagatgtttaatttattgctggaagctgtagtctccgaagattttcagctctctaatgtgtgaatgaagagcttggccggtggagcagcaacaaggagatgaattagttcttctgtagcttaccctgacacaaacataaatagaagtctaaaaatctgggagaggaaagatggtttattctttttcttgttgtattgttgttcttattttgcatggaaattctcttagaactgtcttagaaataggcaggcaaaagggaagggaagtaggacacagaagacattgagtgggaaggaggtgaatctcaaagtggctctcatgattctcatgtatttcattcaccaaacacttattgtttac

SEQ ID NO: 12733 - DNA, 2503 bp, Homo sapiens
ctccgccccctccgcgccagccttttgctctttcctttcattaaacaaacaggagatcctgaaacctggaccctgtgcaagctgcagcgccaggaggaggcagcggaggaagcagagcgcgggatgggcgcccagcggcatctgtgatcccgcgcacctccgccccacgggcgcgcgcacaaacacggacacacacatacacacactcgcgcacacactcgcacaaacacacactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgtaaaaaaactca

SEQ ID NO: 12734 - DNA, 2083 bp, Homo sapiens
tgatggagggagtgtgctctgaggggcaagggctgctccgaagccctgctaatgtctctgtgtggccatgctgtattttcagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgtaaaaaaactca

SEQ ID NO: 12735 - DNA, 2574 bp, Homo sapiens
gggattcggaatttatttcgttttctttgcttcttctgtgacccttacttctttcgcctaccggctcagcctgttcggcgtcttgcagcagtgcctgcgatcccgcgtgagtccgtcgctccctccgcgaaaacctggactctttcccagaagccttgggctccagcaccatgcctgctgcagccgccaaagagcgggaagccacaggctctgcgggtcttggttacagcgtctctggtcgtgccgggcctccttctgcatctgttccacggcccggccatctccctcgtgcagcccagaacaattgggaggaagcgttggcgggcggagggggatgcctgttgggcttttccactagttactgagtgttttttgcgaagagtacgttgctatcagtggcgtccgggtcgtctctccctctcttccttttggtccccataaatgagctgttctcggctctgggaaagaaaagccctccagcgattatgcggatctaattaagtcaatcaggaaactgccggagagcggcactggcttgaagcggagtttgtcctgaggcacagcggaacgattgcacgcggccttttcagcggttcgagctcggccagcgccgggctgcaaacggaagcctgagctgggcttggggaactacgcccgcagatttctctaattttattcacaaaactggacaccctcagggaaagcggcaaagccggcgcgagcctccttcccactctggacctagctgcagctccaaagcgagatagctgtctagcctcagccggtacagctcccggcccctttctccacccggatctgcggctgctcagaagcgatcagctcccttagcccaggtgggaggcgggagactccagatcctgtgacccgcggaggcagacctcagacatgttccccatgcacagaaatgactggggctccagtgtgtgcaccttcaactctgaagcccacctgcccacttcaggcgctggcgcggagataaccaccacgcgtctgccgggcaaagttcgagagtgaatttacatcttctctttccgctactcctggccactgtcccctcccagccccatctcccccgcccccaaccctggactatgtggtaggggactcgcttaagcacccaagtactgcgcggttgttgagaccaaggcgagctgcggagcctgtgggctgttgttcgtgggaagagggttgcgacctcaggagagaccgaaaacagcgccacttgaaacccgccggtcctgaagatcacagagttcccggagtggtagggaaggctccacgctcttgagagcagaggcggccaggggcagtgggggacgcttccaggtatgtgggaaggagaacttcatgtctaagtgcgctcttgtgggtttctcggccagctgggccgagcctctctttctctgtcctcatgtgtctgtcctctggacaacagtggctctgtatggcggattgcgaccctgagtgacgggcgcctgtcttgcatcctgtgtcctgtgtcctcccctccagacctcatgcttggtgtccacagagtggacccaggactgcctggaaggcttatcatccaggcccgcgacttccccccagagtctgaagccttgcgacctggtcggggacgacaaacctgctcggggtcaacagcgagaccctagtggggaatgaggatgggtgagggtgcgcctgggttgagggtctgtgactgtagcatggaaaaggagttcatgcagggatcgcactgagggacagccaagaatactccagcggcagcctccctcctaccaattacacgccgcctgctggcacagtggcacctcgggaacaggacgcccttccgggccctgaattggggcagcgcaggagggagggtgcagagccatagcgacctgtgtgtaccatagacatgcacatgcgctcaccttcacgtgtaacccttctgagtcccagacagggtaactggcgaggccgtaagtaccctcgtgggggcggaaatattgccgcgtccctgagtcctctgggcagatgcagagccgcgtaagcctcatagaagcaaagccaggggaacagtgggagctctggcctcgcggtgcggacgctagtaatggattcctggggaacagcgacctctggaggagcctctcatccacacagagtcaggaactaaaggactggttctgagacaaagcaccctttcctcaccctactcccattccacccgcttggaaaagttatccagagacttttaacctccggactccactcttcgcttatgtttgcttttttttccaacctgtacccacgcttcaaaatccctgctccagtcctgcctcttccagaaagaagccttctggccagcccagttcctcttcccctcttcctgttctgagctcattctcaggccacactgcacagccaacctgcttcctgcctgctcttctccaaaaagactgtgaatccactccacccacgccttgtgttgcatgctgggcatgccgttccctgccccaacccaccccaccccccagtgaataaagactgaagttattcattcca

SEQ ID NO: 12736 - DNA, 521 bp, Homo sapiens
ccacgcgtcgaaaggactggttctgagacaaagcaccctttcctcaccctactcccattcctttagttcctgactctgtggggaacagcgacctctggaggagcctctcatccacacagagtcaggaactaaaggactggttctgagacaaagcaccctttcctcaccctactcccattccacccgcttggaaaagttatccagagacttttaacctccggactccactcttcgcttatgtttgcttttttttccaacctgtacccacgcttcaaaatccctgctccagtcctgcctcttccagaaagaagccttctggccagcccagttcctcttcccctcttcctgttctgagctcattctcaggccacactgcacagccaacctgcttcctgcctgctcttctccaaaaagactgtgaatccactccacccacgccttgtgttgcatgctgggcatgccgttccctgccccaacccaccccaccccccagtgaataaagactgaagttattcattcca

SEQ ID NO: 12737 - DNA, 506 bp, Homo sapiens
tgcacctagcgtacacacacatgcacgtggcattagtctttgttccagtcattttctgagaaggagtgtttaagaggtacattttttgacatcttgcatatttgaaactgtctctattcaacttaaacttgatggtaatttgcctaagactagaatcctggatgggaaataaacttctctcaaagttttgaaggtatgtttgttagtaaaggtataggctaagctctgtaacaaacctcccccaaatacagtgacttaaacatctgattaatagtttctatactggccgggccctggtggctcacacctgtaatcccagcactttgggaggccaaggcgggtggatcacgaggtcaggagttcaagatcagcctggccaagatggtgaaaccccgtctctactaaaaactacaaaaattttccaggcgcggtggtgggcccgcgtaatcccagctacttggggaggctgaggcaggaaaatcgcttgaacccgggaggtggaggtt

SEQ ID NO: 12738 - DNA, 838 bp, Homo sapiens
ttgttggtttttttctccctcaaagtgaaatgagagactattgtagggttttgagccaaggagtgatattatctgaattctgttttaaaaggttcattatggctcctgtgtggaggcagggtagctacttagaaaccaagccatctcagcctcccgatttgtagagatgtggtctcactatgttgcccagactggtcttgaactcctggcctcatgtgatcctcccaccttggcctcccaaaatactaaaatgatagatatgagccgccacacctggccataagcttcagccttgagcagatactttctaaacactttatatagggaaaaaaaactaattcttgcgtagccaaggtgttcattttgccgagaataacgtagcatagtgtttacaattacgtgggtgtaatttctagctttgtgatcctgagagactgccttatcctccatatgcctcagttttctcatgtgtaaaaagggggtaataataatacctgacagggatgttgagaaatccatgtaaaagtacttagaacagcgcctgcatatagtgagagcagagaaaagggaaaaggttcgtggtggtgattgcattgatgttattattccttcagggtatcaccaagtcttccagtgccagcattgttcagttgagagagaaatatagatgctaggcatacacctagaaatagcattgacagtaagttacgatttctgtaattatcttcttagtaaaaaacctacatatttataaatcttttgagcaactggaaaaaaagtattaacttaaatttactacaggaaaaatgtattgcaataattatgttactttatacca

SEQ ID NO: 12739 - DNA, 780 bp, Homo sapiens
ttgttggtttttttctccctcaaagtgaaatgagagactattgtagggttttgagccaaggagtgatattatctgaattctgttttaaaaggttcattatggctcctgtgtggaggcagggtagctacttagaaaccaagccatctcagcctcccgatttgtagagatgtggtctcactatgttgcccagactggtcttgaactcctggcctcatgtgatcctcccaccttggcctcccaaaatactaaaatgatagatatgagccgccacacctggccataagcttcagccttgagcagatactttctaaacactttatatagggaatgtttacaattacgtgggtgtaatttctagctttgtgatcctgagagactgccttatcctccatatgcctcagttttctcatgtgtaaaaagggggtaataataatacctgacagggatgttgagaaatccatgtaaaagtacttagaacagcgcctgcatatagtgagagcagagaaaagggaaaaggttcgtggtggtgattgcattgatgttattattccttcagggtatcaccaagtcttccagtgccagcattgttcagttgagagagaaatatagatgctaggcatacacctagaaatagcattgacagtaagttacgatttctgtaattatcttcttagtaaaaaacctacatatttataaatcttttgagcaactggaaaaaaagtattaacttaaatttactacaggaaaaatgtattgcaataattatgttactttatacca

SEQ ID NO: 12740 - DNA, 3407 bp, Homo sapiens
gttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggagaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtttgggttttgttttgtttaatttattgattagtctttaaagtaggctttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagtaaaa

SEQ ID NO: 12741 - DNA, 3443 bp, Homo sapiens
gttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagattatgcctttctaaattatgcaccttctttagtagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggagaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtttgggttttgttttgtttaatttattgattagtctttaaagtaggctttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagtaaaa

SEQ ID NO: 12742 - DNA, 5621 bp, Homo sapiens
  misc_feature (4767)..(4767): n is a, c, g, or t
gttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggagaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtttgggttttgttttgtttaatttattgattagtctttaaagtaggctttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagtaaaatggcttcggtatttttgttttaaatacaaacttgtatatttgcagctctagtgaaccatctcatcatgtaattcagacttggaatcatgattttatttactaaaagccatcaagatgtagaatatagccattagtggcataaaacatccgttcattgcgtattccatactgagcattaaagcccacaaaagtatattggacaccactgttgcctttttgagcttaaaatcagttgttagtatgttagcaactacagattctaatttattcaacaatcatgcaagcatcagaaaatctgaagtttgatgtcaaaagtagggacacagaaaatggttaaagctatgagaaggaatatagggtctacagtgagtgagaatggtctatttacctgagtataaatatcatttgctacttaattcaactcaaaccttagcagatggaatttgttttgaaaagtaaaatttaacaggtttgtacaagcgggttaggaatttacactgcctttttaaaaaacatttttgaaattagtctcaaaactatcgtattgtcacttgttctggcacagtgccagggtttagcagccctcaagagttaatataccatgttctttagggctgactttaagaaaaagaaaaagcattccaaaccaggccaggtagctttgccttgaggtgatctgagccccatgtggcaagtttataaccaacaactgcctctcaggcacgtggtaaaagcctccctagcctcaagcagcttacatctagtttgataaatacgactagcacacttgcagcaattaggctagtagaggcccgcacggtggctcatgcctgtaatcccagcattttgggtggctgaggccagtggatcacttgaggccaggagtttgaagccagcctgggcaacatggtgaaaccctgtctctactaaaagtacaaaaactagctgggtgtggtggcacgtacctgtagtcccagctacttgggagactgaggcacaggaatcacttgaactcaggaggtggagactgcaataagctgagatcacaccactgcactccagcctgggcaacagagctagagtctgccactaaataaaattaggctggtgtagtctggaactcggtttaatatcgtgttagtttaggaatcactcaacattcatttttcaatcccttagattttaaagtagcaagtacagtcagttgacagcataaggaccaggctcagggatcatatgggaaggacacctgctatcctatccttgcctgactaccactctgtttcctcccataacaccctctgcctcccaggtaagcatcaccaccctgaatttattagttcttaagtccatgaagccntgacatggtatgcaatttatatgtaaatgatttcccctattcttaaagttttgtctactcaaagggacctgtaattaaaaatgtaagagtgactgtcttgtatccatttacttgctagtttctccctactagaaccttgtgttaggccgttctcgcattgctataaagaaatactcaggactgggtaatttataaagaagagaggtttaactggctcatgcttctgtaggctgtacagggagcatggagctggcatctgcttggcttctgggaggcctcaagaaacatggcagaagggtaagcaggagcaggaatctcacttggtgggaacaagtgggggtaggcgaaggtgccacacactttaaccagatctcacatgaagtgaactcactatcacaaggacagcaccaagccatgagggatccgcccccatgacaaacacctcccactaggccccacctccaacattggggattacatttcaacatggatttgggtggggacaaatatctaaactatgtcaaacatatcttccctctgtctgccaggctggagcgcagtgttgccattatggcccactgcagcctccacctcctgggctcaaaaaattctcccacttcagcctcctgagtagctaggatcgtaggcatacaccaccacatgcctggctcatttttacaattttttgtagaggtgggcgtggtggtgtgtgcctgtagtcccagctacttgtggggctgaagcaggaggactgcttgagcccaggaggtcgaggctgcagtgagccatgtttgtgccactatactccagcctgggtgacaaagtgagaccctgtctcaaaacaacaacaacaa

SEQ ID NO: 12743 - DNA, 4207 bp, Homo sapiens
  misc_feature (3353)..(3353): n is a, c, g, or t
tccaccgggcataattgaactttgggaccggtacgggatcaacatacagatctgtgtgaagggtgaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggagaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtttgggttttgttttgtttaatttattgattagtctttaaagtaggctttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagtaaaatggcttcggtatttttgttttaaatacaaacttgtatatttgcagctctagtgaaccatctcatcatgtaattcagacttggaatcatgattttatttactaaaagccatcaagatgtagaatatagccattagtggcataaaacatccgttcattgcgtattccatactgagcattaaagcccacaaaagtatattggacaccactgttgcctttttgagcttaaaatcagttgttagtatgttagcaactacagattctaatttattcaacaatcatgcaagcatcagaaaatctgaagtttgatgtcaaaagtagggacacagaaaatggttaaagctatgagaaggaatatagggtctacagtgagtgagaatggtctatttacctgagtataaatatcatttgctacttaattcaactcaaaccttagcagatggaatttgttttgaaaagtaaaatttaacaggtttgtacaagcgggttaggaatttacactgcctttttaaaaaacatttttgaaattagtctcaaaactatcgtattgtcacttgttctggcacagtgccagggtttagcagccctcaagagttaatataccatgttctttagggctgactttaagaaaaagaaaaagcattccaaaccaggccaggtagctttgccttgaggtgatctgagccccatgtggcaagtttataaccaacaactgcctctcaggcacgtggtaaaagcctccctagcctcaagcagcttacatctagtttgataaatacgactagcacacttgcagcaattaggctagtagaggcccgcacggtggctcatgcctgtaatcccagcattttgggtggctgaggccagtggatcacttgaggccaggagtttgaagccagcctgggcaacatggtgaaaccctgtctctactaaaagtacaaaaactagctgggtgtggtggcacgtacctgtagtcccagctacttgggagactgaggcacaggaatcacttgaactcaggaggtggagactgcaataagctgagatcacaccactgcactccagcctgggcaacagagctagagtctgccactaaataaaattaggctggtgtagtctggaactcggtttaatatcgtgttagtttaggaatcactcaacattcatttttcaatcccttagattttaaagtagcaagtacagtcagttgacagcataaggaccaggctcagggatcatatgggaaggacacctgctatcctatccttgcctgactaccactctgtttcctcccataacaccctctgcctcccaggtaagcatcaccaccctgaatttattagttcttaagtccatgaagccntgacatggtatgcaatttatatgtaaatgatttcccctattcttaaagttttgtctactcaaagggacctgtaattaaaaatgtaagagtgactgtcttgtatccatttacttgctagtttctccctactagaaccttgtgttaggccgttctcgcattgctataaagaaatactcaggactgggtaatttataaagaagagaggtttaactggctcatgcttctgtaggctgtacagggagcatggagctggcatctgcttggcttctgggaggcctcaagaaacatggcagaagggtaagcaggagcaggaatctcacttggtgggaacaagtgggggtaggcgaaggtgccacacactttaaccagatctcacatgaagtgaactcactatcacaaggacagcaccaagccatgagggatccgcccccatgacaaacacctcccactaggccccacctccaacattggggattacatttcaacatggatttgggtggggacaaatatctaaactatgtcaaacatatcttccctctgtctgccaggctggagcgcagtgttgccattatggcccactgcagcctccacctcctgggctcaaaaaattctcccacttcagcctcctgagtagctaggatcgtaggcatacaccaccacatgcctggctcatttttacaattttttgtagaggtgggcgtggtggtgtgtgcctgtagtcccagctacttgtggggctgaagcaggaggactgcttgagcccaggaggtcgaggctgcagtgagccatgtttgtgccactatactccagcctgggtgacaaagtgagaccctgtctcaaaacaacaacaacaa

SEQ ID NO: 12744 - DNA, 162 bp, Homo sapiens
ttgagttggggatggggcatgattttcttgcagatttcttctcaagcagtatttttaatagtttcctttctctccacgtttcagcgctcatgataatgatgtgaaagaagcaaacaaacagagagggcaagcaggacctcagtcagcgcaactaagtgtatt

SEQ ID NO: 12745 - DNA, 3687 bp, Homo sapiens
gttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggagaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtttgggttttgttttgtttaatttattgattagtctttaaagtaggctttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagtaaaaaaaaaaaaaaaaacaaaacaaaaaaaaaaaaaaaaaaaaaaaaaacaaacaacaaaaacaacaaaaacacaacacaccaacacaaaaaccacacagaacaaaacaacacaaaacacaaaaactacaataacacccaaacaatcatgacgggcgcggcgccttgtcccctactttgtccttcttccaacggcggcagcacacaaagttgactatgcacgacacacgctgtatcttgatctgaggccaagatggcgtgcgaccgcactccaaggccaagtta

SEQ ID NO: 12746 - DNA, 389 bp, Homo sapiens
cacagaggaatgcttgctcaccaagttcaccttgccaccaccattgctttcagtagtgctctgattacaggcaacttctgcccagtggtgctgtgcaggagctgcctgtaacccctcccctgcctgtgtttctggcactgggccatggcacctgcagtggcagtctatctgaaaagcagcggctctgctgtggattttgttctgcctctggatgctttcatgcaactctgcacagggttacccgataaatgactgcttactgtggtatttatgtctgtttgatttgccggtaactggtgtatctcaaacgaaaatttcttagcaaagacttctgtatatactagcaaatttccttgattatgttaaccactgtgaccttcccacccacc

SEQ ID NO: 12747 - DNA, 340 bp, Homo sapiens
tttatgttggaatattataattctcctcttttagctattttgatatatgcaataaattattattaactataatttccctgttgtactgtcaagtattggaacttattccttttacacaactgtgtttttgtaccccttagtcaacttctctttactttcctgcccacttcccttcctgcccctggtaaccactattctactctctaccaccatgaaaggtcttcagttgttgatagtgattcttctctcggtttttgtcgaggtctttgcacaaactgatcacggaaatcacactggtaatgccaattgagtttggtttagcgaaaaaaaaaaagttttg

SEQ ID NO: 12748 - DNA, 576 bp, Homo sapiens
tgatgctatatcttaaatacgtttgcctaaacaagagaaaacaaaggttttctcttacgttttctttttcctaaagaaagtttataattttaggttttacatttagatcgataatccagttggggtcaatttttgtctataatacaaggaatgaattttaagttcatttttacatatgaatatccatttgttgaaaaaactttcttttttccactgaattgcctttgcacctttgttgaaaagcagttgtccataattgtgcgggtctacctctaggttctctattctgttccattatcttttatatgactactatactgttttgagtaaggtaggtttataatatatcttaaagtcaggtaaacgttaagtcactagtttgtttttttcaaatccgttttgactaatttggcttctttgcatttctacgtgaatttgaaaataagcttgtcattttcttcaacaatgcctgctgggattttattggaattgcactgaatctatggataaatatgggggagacccaaaaactttacaatattgagtcttctgacccatacacaatctctctctcca

SEQ ID NO: 12749 - DNA, 397 bp, Homo sapiens
ataatatatatagagagatataaatatataaaaatatagatatgtaaattgggattgggtataaacagtcaatcagtttcttagggataagtagaaaagatagaatgttacatatttcttatgtaatacataatttgtattcttaatgtgggaaattccatgatatgctaaatgtctggttatgtttagagtttttagtgcttagtgtcaggaagattaaaaaatatattaaaagtatgttttgaaactaccttttttggttttaagaacaaatgtactggccgggcgcggtggctcacacctgtaatcccagccctttgggaggccgaggcaggtagatcacgaggtcaggagattgagaccttcctggctaacatggtgaaaccgtgtctctact

SEQ ID NO: 12750 - DNA, 766 bp, Homo sapiens
taacaaaaaaatctggaaaagacactaaaagaaaactatagaccaatatccctcataaacatactctcaaaaatctttaataaaatattagaaaatcaataaggttaagagctctgttgtataacatggtgactacagttaataacaatgtataatatttttgaaaattgctaagagaaaagattttgtgttctcatcacaaaaataggtatgtgaggtaaaacacgttaattaattcaatttagccattccacaatgtatgtacatattttgaatcatgcaatatacagtacatacaatttgtatttgtctatttaaaaattaaagggtgactatagttaataatgtattgaatgttctcactacaaagaaatgataaatgtttgagctgatggtgtgaaaggaaaataaatctcggtatcccaaaatcactaagccaaagggaaaagtcaagctgggaactgtgtcaggcaaacctacctcccattctattcctaaaggagatagcaacagagataaaaaataaaataaaataaaataaaataaaataaaagaagaagctacattaactccctcacaatttgcccataaggaaattccccgcttcaaattgtctttcccctgcccttctggccaatgtacatcttacatgtattgattgatatttcatgtctccctaaaatgtataaaaccaagctgtgccccaaccaccttaggcacatgtgtcaggacctcctaagtctgtgtcatgggcacacccttaacc

SEQ ID NO: 12751 - DNA, 393 bp, Homo sapiens
ctcccacctcagtctccctagtaggtggaactacaggcatgtaccaccacacctggctatttttttttttagagacagggtcttgctatgttgcccaggctggtctttaattcctgggctcgagagagccactcatccccatctctcagagtgttgggattacagccatgagccaccatgcccggccaaacttcagccttgaatattagtgattttgccatattagtttaccatctgtacaattatttgctttatatttttctttaaattggctcattattcacttaatgaaattattgcaacaggaatcttttgtatcacttctgtaaatggaaaaccagtctcatttgccatcaatagaaggtaaaacatgaaaataaatacaatgtaaac

SEQ ID NO: 12752 - DNA, 309 bp, Homo sapiens
agaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggt

SEQ ID NO: 12753 - DNA, 603 bp, Homo sapiens
gcatcccacctcccggggggttcatcggcagcgcaggggctttgccaagacaggagtgctcctggaagcttcacgttttgagaaagaatccgtgaccaccaagcaaaccaccctatacctaacggtggaacagtttgtccccacatttgcgagacgtgtttatgtgtctgttgaaccgtgtccgtggctcaggggacatgggcctcggcggtgaggcgcaagagggcaggggccgcctccaggctgcgcgcggcggggcgagagcccccagccgcccccgagctccgcacctgtgcaggctggggctgcgcgcgagatgctcggctcccggccctgccactccgggctttttgatgatttgatgttttagaaaacgattatgagagcttacgtgtattaaatgttgaaagaaatggaaatattatttatacctataaggatgataagggaaatgtcgtctttggattatatgattgtcaaaccagacaaaatgagcttctatatacctttgagaaagacttggcaagttttcagttgctctgtcaacagtgaaagggctttgcttgctgcaagtttagttcagtctactaaagaaggaaaaag

SEQ ID NO: 12754 - DNA, 391 bp, Homo sapiens
ttctccttccttaaaggttactactgtttgtacttctaataaaagagattcgttttgcctgtttttaagttttatataatagaattattagtatatatttatatttggcttccttcactaatatattggttagatatgtttttaaccatcttctgctgagtattaacctcctattatcatttcagatgttttagaaaacgattatgagagcttacgtgtattaaatgttgaaagaaatggaaatattatttatacctataaggtatgtctatattcttttttattgtggtaagatgtaaaatttactgtttttaatcatttatattctctttttacagaattctatactgtatcttattgaagggtaatgaataaacttgttggcatttaa

SEQ ID NO: 12755 - DNA, 413 bp, Homo sapiens
gcatcccacctcccggggggttcatcggcagcgcaggggctttgccaagacaggagtgctcctggaagcttcacgttttgagaaagaatccgtgaccaccaagcaaaccaccctatacctaacggtggaacagtttgtccccacatttgcgagacgtgtttatgtgtctgttgaaccgtgtccgtggctcaggggacatgggcctcggcggtgaggcgcaagagggcaggggccgcctccaggctgcgcgcggcggggcgagagcccccagccgcccccgagctccgcacctgtgcaggctggggctgcgcgcgagatgctcggctcccggccctgccactccgggctttttgatgatttggtaagggagtgaaagtgacttttgagccttcccagcactgatctgttttaaa

SEQ ID NO: 12756 - DNA, 371 bp, Homo sapiens
cctgaactgctccagaggacccagctctctcaagccaagtggtttccacactttgctgcacagtggaggcacttgtagaataaagaaaataggccgaccctccaggtttggaagccactgggctagcggcctcgccaaggccctgaagcgcccacgtctttgcgccctctatcctcagccccgaagatgttttagaaaacgattatgagagcttacgtgtattaaatgttgaaagaaatggaaatattatttatacctataagcttctatatacctttgagaaagacttggcaagttttcagttgctctgtcaacagtgaaagggctttgcttgctgcaagtttagttcagtctactaaagaaggaaaaag

SEQ ID NO: 12757 - DNA, 1663 bp, Homo sapiens
atgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagttta

SEQ ID NO: 12758 - DNA, 1362 bp, Homo sapiens
atgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagta

SEQ ID NO: 12759 - DNA, 226 bp, Homo sapiens
tttagaatagtcttgatttcagataatttcaaatctaaagctcaaacaatttcattctaaaatgtaggtattttcttacagttagagaagtgaaatgttatattttttcgttgcatgcatccggcacataagttgtagtcttgaatttccataatgctcctgtgaggtggatatgagctcagccttacagacaggaagacagcctctgaccctccttacatcctca

SEQ ID NO: 12760 - DNA, 991 bp, Homo sapiens
gttggatgagcccaaactgcttggagtttctctcagtaagaggcactgggggaaaaaaggactgaattttccctttctctgaagcttaaactgtgccagggtgaatggatgttgcagcatgcaatttttgtttttatataaagtttagcctaatcaaaatagttgcatattattttcttagtagtcattgtaggaaacaccaattttttcttttctctctctttttctttctttctttctttctttttttttttaagaaagggggtgatctgtctagcttgtggactctctcaatattcaccctgtctctgaaaatcaccctcccacctccttgaattctggtgaaggcagtcccacaagtttgtgttccaccggttgaatagccctgttaggaagacatccattttcccccacaagttcccataaaagccgtggggctgacccttactggactcaacttggggcatggccccatccttgacctaagtatggcccgtggggctgtgctgaaggtggttccttagaataaatactgggcaggcaaaaacaatataggtgctgactgggcctagggtattctaggatattctatgtcttactactcagggtatcatgctctggtcagcagcatcaccattacctggaagcttgttggaaatgcagactcatagactcttaggccccactgtgggatctcatggatcagaatctgttcttaacatattcctatgcacattggaatttgagatgtgtgcagtgctggagcaagtcagggaactctggcccatatccatctctttttcatggcatatccctgtatacacactgggcacctccatctcccaccagggctcacacctttgaaaccctaaagcagtgtgtgtcaagagaggccccaccatgatgaattgcttttagatgttcctatagtttcctttaagaccaggaatcagcatttcctttgttagctaggtaaaaataatgaattgga

SEQ ID NO: 12761 - DNA, 1018 bp, Homo sapiens
gttggatgagcccaaactgcttggagtttctctcagtaagaggcactgggggaaaaaaggactgaattttccctttctctgaagcttaaactgtgccagggtgaatggatgttgcagcatgcaatttttgtttttatataaagtttagcctaatcaaaatagttgcatattattttcttagtagtcattgtaggaaacaccaattttttcttttctctctctttttctttctttctttctttctttttttttttaagaaagggggtgatctgtctagcttgtggactctctcaatattcaccctgtctctgaaaatcaccctcccacctccttgaattctggtgaaggcagtcccacaagtttgtgttccaccggttgaatagccctgttaggaagacatccattttcccccacaagttcccataaaagccgtggggctgacccttactggactcaacttggggcatggccccatccttgacctaagtatggcccgtggggctgtgctgaaggtggttccttagaataaatactgggcaggcaaaaacaatataggtgctgactgggcctagggtattctaggatattctatgtcttactactcagggtatcatgctctggtcagcagcatcaccattacctggaagcttgttggaaatgcagactcatagactcttaggccccactgtgggatctcatggatcagaatctgttcttaacatattcctatgcacattggaatttgagatgtgtgcagtgctggagcaagtcagggaactctggcccatatccatctctttgtgtgggcggacatatgctaagatccatgattatcgagatcgaagtgctgtattgatgactacataggatattcatattagcagtgaattttgttttggacatagtcctatgcacatggggctaagtgagtgcttctcccttcctgtaagtcagggtaatgatgtactagaactcaatttctgatacatggacattatcctgtatacagcacttggta

SEQ ID NO: 12762 - DNA, 393 bp, Homo sapiens
gcgacacgcaggatggccaggcccggagcagctgcagccccggcgccgaacgccgcggcgacttccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatgggtaa

SEQ ID NO: 12763 - DNA, 434 bp, Homo sapiens
aaatctgaaaaggagctaatatttgatgattggccctaatggaggattgggttttgaccagcaatagtagagggaaaaatacaagatttctaggtggagggaacagcgtgaataaacacagaagcaaacaataaataaagaccctcggccgggtgtggtggctcacgcctgtaatcctagcactttgggaggctaaggcgggtggatcacgaggtcaggagatcaagaccatcctggctaacacggtgaaaccccgtctctactaaaaatacaaaaaaattagccgggcatgatggcaggcatctgtagtcccagctactcaggaggctgaggcaggagaatggcgtgaactggggaggcagaggttgcagtgagccgaaatcgcctcactgcattccagcctaggcgacagagtgaaactctgtctgaaaaaa

SEQ ID NO: 12764 - DNA, 527 bp, Homo sapiens
tgtctctactaaaaatacaaaaattagctgggcatggtggcacatgcctgtaatcccagctacttgggaggctgaggctggaaaattgcccgggaggcagaggtttcagtaagccaagattgtgccactggactccagcctgggcaacaaagcaagactccgtctcaaaaaaaaaaaaaaagtagttctttatttaccatgcgatctttccagtacacttgctaattgctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcga

SEQ ID NO: 12765 - DNA, 384 bp, Homo sapiens
tttagttattaatgcctttatatttttatcaagtaataatagtttatatttattctcataataagtactggtccttatttactattgaacacttacatggcaggcatattttaagcaatttacatgagtttacttatttagtcttcaaagcaaccctatgaggtgcatactattttcctccctattttaaagataggaaaattgagagattaagtattttgcctctatttacaaggttagtgaaagattagagccaagactcaagtcgaagcagtacaattccaaatcctgcacagttcgccttctgtttccatgagttctgtgtccatagattcaaacaaccttagaatgaaaatattcaggaaaaaagtaacacaacaataa

SEQ ID NO: 12766 - DNA, 597 bp, Homo sapiens
tgagtaattagcgattgctgtgtgttttcatattttcagaatagggatataacctcactgaagatgacataattagtacttgacaaagctaaaagtcctgtcagtatatttatacctatgcgtaagtatgctctctgagtcattctgctaattcccactgtaaaatacgtatacccttttattttattagaattaaagggctttgaggagatttttcattttaaaggtacaagacaagttttaacgtcaacatagcccactcactgttctatatttatgtgagaccttttaagaaccagggataaatgagctctaatttgtctgtgagggtctttccccgtctatctttaaaacttaacgtgttcctataggagtaactatataatatttgacaactgttatcccaccgtccacttgggaagcacacaagtaataaaagtaaatcaaattatgacactgtgtttagcatgacatcttaatttgaactatgagaaaccattattggaccaatgttggatttttactaaagacttgtagttgtcctagcacgtattaggagatgccaaatgaataagcctaggagtgattgtcatgggg

SEQ ID NO: 12767 - DNA, 1910 bp, Homo sapiens
gtgaactgtcacccttacaactcagcttgcaaccagccctggccaccaccagtttccccacactgagctgaatattggacatgcccatcttagacattccagcccattctgaaattccacatcgattcacccgacaaagtctgaagttccagggcaatttatctggaaaagctcacctggaatcatgtgtcatttcaaccaacaactgtcgaagaggacgtggcatcaaaaccaaggttatcaattatttataagggttgtgtggtggttggtccaagcatctctccttcatgccatcactcctttcaagagctgcctctattttctaatttagcacaggaatttagatgcccctaaataagtaggcatccagtatctgcccacaccagttttagtgagagtacatatggagacactaccaccacccctgctctcctactgcataccccaccatgccaaagcatggtggctcacacctgtaatcccagtgctttgggaggccaaagaggaggaacacttgaggccagaagtatgagaccagcctgggcaacatagtgagacctcatttctataaataagttaaaaaaacaaaaaaatagggcatagtggtgcacatgtgtggtcccagttactcagcaggctgaggctggaagatcacttgagcccaggagtttgaggctgcagtgagctaggattatgccactgcactctagcctgggcaacagagagagaccccatctctaaaaagagggagaagaaggaaggaggaggaagaagaggaagaggaggaggagaaatactgctctttctcaggcccaaggtaaaaaggtttttggtctcatgttgaccagaaagacattgatatttaattaagcaatataaaaaggctcattgttaggattaaagagtaagtaaaatcaatattgagataggaggatggaggacaccaactgagttccgatcccaatgaagaggagaaaaagctacaactatctaggtgaaatatctacttatcctagaagaagccttttgacagcaacataaaattcatacctataggtttttaattcctatggatgccgtagcaaataacaaaaacttggatggtgtaaagtaacagatgtttactcttttccagtattggagaccaggaatctgagatcaaggtgtgggcaggggtgcgctccccctggaggttctaggagaggatccttcctgcctcttccagctcctggtggctccaggtgtccctgggcttgtggccacatcactacattctctgcctccatctccacgtgaccttttcctctgtgtctgtgtctcctcttctgtctcttagaaggacactggtcattggatttaaaggccacctgggtaatttatagtgatctaatctcaagaatctttccttaattacatgcaaatactctttatccaaattagtttgcattcacaaattctggagcttagtacttggacatatattttggggggttgatggttggaggggcttttattcaactcagtacatcttaataaggaattaatgccccccaacttgccttacaagtcatatattaaaaacaatgttggcctggcacagtggctcatgcccgtaatctcaacactttgggaagccaagggaggaggatcacttgagcccaggagttggagaccagcctggataacaaagggagacccagtttctacaaaatatttaaaaattagccaggcatgatggtgcatgcctgtggtcctagctattcaggaaactgaggtgggaggatcacttgagcctggaagttcaagacagcagtgagctatgctcacaccactgcactccatcctgggcaacagagctggactctgtctcaaaaaacataacactaaaacatcaaaattaaaaaaaa

SEQ ID NO: 12768 - DNA, 916 bp, Homo sapiens
aatataaatgacttacatagcattttagatcagtggatgtttttgtgattcttttatttgagctttgcccaaagataacagtacccacaggttttttccgagctacctcgcatcttctcccatcagtggccctcgagcctggaaaatctgacatgacaatgtgcttgctcaacctaccaccgtttttcttttgaaaagtttggcagcctgtttctgactcctatgaaggtgaattcctcagcattcacagtttattagaaaaatactttgcttctctccaaactcgaaattcaagataaccaaacctatatataggctgatctttcaggatgcagttgtcatgttgatgccatgcttttcagtatcgtggccatcatctgttcagtaggggaggtgtacttctgtaatgggaggtggtggttatgtgtgtgtgcaagtgtttatttggtgtcttaagttagcctgtgggaagttctaaatcaggatggtacgtggttgccagcagagagctgctcctcaagtgaaggaggtagaatcaaagccaataggaaagagcctcagatgcttatatatgtaccgtggggattcagagtgaaagcagtcattggactaggggtggggttagggagagcctgtctgacagacacaagaaagggatggataacgccacccagagaaaaaagcattttaggcaagaacaaatatgaaaaaggaacaaagtctgtgggtggggggcaaggaggagataagttgacttgaaggaagacaacacttatgaaagtcacctggaggctgggtgccatggctcatgcctataatcgcagcactttgggaggccgaggtaggaggacaacttgagcccaggagttcgagaccatcctgggcaacatggtgagactgagtctctaccaaaaaa

SEQ ID NO: 12769 - DNA, 827 bp, Homo sapiens
  misc_feature (21)..(21): n is a, c, g, or t
tgaatccgactcactataggncgaaatgggtaaggggcccccctcgagcctggaaaatctgacatgacaatgtgcttgctcaacctaccaccgtttttcttttgaaaagtttggcagcctgtttctgactcctatgaaggtgaattcctcagcattcacagtttattagaaaaatactttgcttctctccaaactcgaaattcaagataaccaaacctatatataggctgatctttcaggatgcagttgtcatgttgatgccatgcttttcagtatcgtggccatcatctgttcagtaggggaggtgtacttctgtaatgggaggtggtggttatgtgtgtgtgcaagtgtttatttggtgtcttaagttagcctgtgggaagttctaaatcaggatggtacgtggttgccagcagagagctgctcctcaagtgaaggaggtagaatcaaagccaataggaaagagcctcagatgcttatatatgtaccgtggggattcagagtgaaagcagtcattggactaggggtggggttagggagagcctgtctgacagacacaagaaagggatggataacgccacccagagaaaaaagcattttaggcaagaacaaatatgaaaaaggaacaaagtctgtgggtggggggcaaggaggagataagttgacttgaaggaagacaacacttatgaaagtcacctggaggctgggtgccatggctcatgcctataatcgcagcactttgggaggccgaggtaggaggacaacttgagcccaggagttcgagaccatcctgggcaacatggtgagactgagtctctaccaaaaaa

SEQ ID NO: 12770 - DNA, 494 bp, Homo sapiens
ctacaaacagtgagattggttattactcatgatattaaaacagaatttcagaatctagaatatctgaggtcccactgctttagagggagtacatttatgattcactgctgttcaatatttaccaaaactttggattagaaaaataatatttatgtctggatcataaataagagaaaatgtctgggtcttagatcagaggaaatttatttttactttatgtttgaaataggttctaggaactctaaattatggctcacacttgtgatctcagccctttgggaggccggggcgggtggatcacctgaggtcaggagttcaacagcagcctggccagcgtggtgaaaccctgtctctactaagaatacaaagttggccaggcgtggtggcgggcgcctgtagttccagcttcctggggggctgaggcaggagaatggcatgaagccgggaggcagaggttgcaggttgcagtgagatcacacctctgcacacctacc

SEQ ID NO: 12771 - DNA, 548 bp, Homo sapiens
ctacaaacagtgagattggttattactcatgatattaaaacagaatttcagaatctagaatatctgaggtcccactgctttagagggagtacatttatgattcactgctgttcaatatttaccaaaactttggattagaaaaataatatttatgtctggatcataaataagagaaaatgtctgggtcttagatcagaggaaatttatttttactttatgtttgaaataggttctaggaactctaaattataaaacataattccataaacataccattgttaaacaagtctaggctgggtgtggtggctcacacttgtgatctcagccctttgggaggccggggcgggtggatcacctgaggtcaggagttcaacagcagcctggccagcgtggtgaaaccctgtctctactaagaatacaaagttggccaggcgtggtggcgggcgcctgtagttccagcttcctggggggctgaggcaggagaatggcatgaagccgggaggcagaggttgcaggttgcagtgagatcacacctctgcacacctacc

SEQ ID NO: 12772 - DNA, 688 bp, Homo sapiens
aaaaaagaaaaaaacaaaggattcaaaaggattcagctgttttgtattcagctgaggtaagtggcggcatggagcatggagcgattatttacatttaaaagaaaagaattgaaagtaagcacctgtatctctatttttattctgtgggtcttccacaaacgctttcgtcttatttcagaaaacagcttctgtgttcagtcacaggagccatcggcaaagaatggaagtggaaatgctacctccagggtcttggtgagagaaagtacagctttacctgataggtgatttcccttggaatccatcagaactcgacaaagcatgattttctgagcctagtaaaatggttctgaatcaaaaccgaagtcacgctgtgctgccgatccctgtttgactctcaaaaccaaaatctgtatcaggaaaggaataatcatttagcagactgagtccaaaatgctcatttttggtttcctgtgaaaatggatttctttttgtcgctttcctttttttttttttttttttgtgagatggagtctcactctattgcccaggctggagtgcagtggtgcaattttgactcactgcaaccaccgcctcccaggttcaagcgattctcctgcttcccaatcccaagctgctgggattacaggcatgcgccaccatgctcggctaattttttgtattttcagta

SEQ ID NO: 12773 - DNA, 426 bp, Homo sapiens
ggtgtttggatactaagtaaccaaaaccaaaaatgccagttacactcaaggatgtttcttgagcactagctttgataggtccctggccaagtgctctacaaatactatttcctttaatcattaaaacaaacctgtaagttggaaactattattatccccatcttatagacaaggaagttgaagatgcctttggtcacacagctagtgtgtacgggatggagctgagatttggccctagctccatctcactccagagtgagatgcttatccactatgctccagagggatcaagaatggccaaaaataggccaggcatggtggctcacacctgtgatcccaatgctttgggaggccaaggtgggaggattgtttgaggccaggagatcaagacgagcctgggcaacatatcaagatcctgtctctaca

SEQ ID NO: 12774 - DNA, 559 bp, Homo sapiens
gcggccgctccaacatcagaatggtaacaccacatgcccagtgtgagggacaaagaaaggggcgtccattacggcaaagaaaggccaagcctggatgggctctcacacacacacacgccgggaagagcatgcctggatgggctctctcacactgggcatgtggtgtttccatccaaaatcaggacagggcgtctgtctgtggcatcagtgtccccaggcctggctgagggctcctgctcgtgactggccagctttctccattatattctatggtgtgctggtcactgtcaaccagctgtcccaggcatccggtcctgggccccggccgtggcgattcccaggtgtgaatgtgaacgctctgcacggcagcagagagtcccttgcctgcctcgtcctctcagctgcagcccctgcggcagactgggcttgactcttcttgggacgctcagcagggaggagcctgagcctgcagggtttccataagcgtgtgtggactgaaatgtggatggatggacagtcagacagacggaaaggtctgagtagtgacctttccacctcg

SEQ ID NO: 12775 - DNA, 780 bp, Homo sapiens
tgtgtgtgtgagagcccatccaggcatgctcttcccggcgtgtgtgtgtgtgtgtgagagcccatccaggcatgctcttcccggcgtgtgtgtgtgtgtgagagcccatccaggcatgctcttcccggcatgtgtgtgtgtgagcccatccaggcatgctcttcccggcgtgtgtgtgagcccatccaggcatgctcttcccggcgtgtgtgtgtgtgtgtgagcccatccaggcatgctcttcccggcgtgtgtgtgtgtgtgtgagagagcccatccaggcatgctcttcccggcgtgtgtgtgtgtgagagcccatccaggcttggcctttctttgccgtaatggacgcccctttctttgtccctcacactgggcatgtggtgtttccatccaaaatcaggacagggcgtctgtctgtggcatcagtgtccccaggcctggctgagggctcctgctcgtgactggccagctttctccattatattctatggtgtgctggtcactgtcaaccagctgtcccaggcatccggtcctgggccccggccgtggcgattcccaggtgtgaatgtgaacgctctgcacggcagcagagagtcccttgcctgcctcgtcctctcagctgcagcccctgcggcagactgggcttgactcttcttgggacgctcagcagggaggagcctgagcctgcagggtttccataagcgtgtgtggactgaaatgtggatggatggacagtcagacagacggaaaggtctgagtagtgacctttccacctcg

SEQ ID NO: 12776 - DNA, 382 bp, Homo sapiens
tcgatttcccaaagtactgggattacaggcgtgagccaccacaccgggctctgaggccactttttcatccatattcttctctgtgcctctgcatgtgtgttccccatccctttggtaacttctattttttatttcaggagtgggttaaagtttccgattttttttttccttatactctctcagttcagtctggaccaacttggagaagagcggcggctttccctccctttttctgtggccgccttcagacgctggcccatgggagagtcagggctgtcccccgtgttggagctattaaactgtcgtaagaaaggggcctttgtcacgggaaacacgttactcagctcagtcatagagacagactgtgccagaaaacaaacaa

SEQ ID NO: 12777 - DNA, 1256 bp, Homo sapiens
attgttcaggtgaggacatgtgtccaggatgagtggggagtgggtggcaattgcagggcctgaagtcaggtgcatccaccttttccctgagactgatctgtggacagtggtgcacgtccccagtcctcgcccttgggaaggtcacagggctggccgggtccctgtgtgaagtttcatccagcacccaggccagggccccactcagtgcctgtgattttcatgtgagcttaggtccttccctgcttgccttgagggcgggtaatcaggggcacactcgcttggcacttcctggcccatcacgtgacgttgacaagcagcctgcaggaaatggaagccgatgactccagtgacattcaaaaatagctgcaaggtcccttatcccctgcagtcgccacctgtcgggacaaatctgaaatgtgatcagggctccaggaagcggggaccgagatgatgtgggcagagccttggggcctggcaagctccgaggtatttgacagtttcagcccccacatgcgcagagctgcctctggctgcactcagcatcttaatgagcaatgacacatttgtcatctctgacttgacagaactttcctcttggctcagtgtttcccaatgttctcaggtggcaccttcaacactcagaaattaaaattcatcctgggcatgggtcaccactacctctttcccctcgcaaacattctcccatgtgtcaatcaggaagcaggtgtgtccagaatgcatggagaagctgtgtggtgtgagctgcatgcacagtgtagttaggagtgggtgcagggtctcactctgccaccagctagcggccaagtgccctccattacccaagcctccagagtggcctggtgggcacgcccttacagcatcgctgtggggtgcatttagctgctgtgcaccagcctgaggggcaggccacgcttcgagggctccagagatggtagctggatgcccatcccctgggaaatcgagtggaagagcaattgatttccccactgccattttatgtctctgtttaaaatgtgcaagatggttcttttaaaggaggaaaaaagagaaaaagcccttccctgcattgccctgtgttgccctgcgtggggctccgcagtcggtgcactatggaatttcttcacattgtgaaggacctgcccactcctgacagcagtaactacagtaggagtttcaggttggagccttaaattgggttctcaaagaaagctgtcattactctctgtaatttttca

SEQ ID NO: 12778 - DNA, 675 bp, Homo sapiens
gagtggaggctggagttttctcggacagtgaactctaccgccccagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaattcc

SEQ ID NO: 12779 - DNA, 668 bp, Homo sapiens
cggacgcgtgggcaggtctgaggcagctagtagccggagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaattcc

SEQ ID NO: 12780 - DNA, 714 bp, Homo sapiens
cggacgcgtgggcaggtctgaggcagctagtagccggagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaattccacatagtatttgcattgttttataaataaattccacttactatcaa

SEQ ID NO: 12781 - DNA, 704 bp, Homo sapiens
ggcgaacgaaacgcggagctcgggagcgacccggcggggccaggcacgggcagaagggccaagagggccacagagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaattcc

SEQ ID NO: 12782 - DNA, 746 bp, Homo sapiens
cacgccgccggccgccgtttagtcccagagatagaaaaaagtagaggtaggagggcgcggcggctcacgcctgtaatcccagcactttggaaggccgaggcgggcggatcacgagagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaattcc

SEQ ID NO: 12783 - DNA, 449 bp, Homo sapiens
gttttctcggacagtgaactctaccgccccgtgagaccctgccctatgtgtcgcgggaacacatgtcaccccacagctctctttgagtgacctcccgaccacccattcctgcctaaccctagcattccttcctcagcctcaaggtcccagtgctaccctctcccccacgacccctttagacgggcatgcgacctccacacacgcctcactttatgtgatagtcagactagtcgcatctctctgtcctccctcagttgccttttcagaggctacctcccctgtagagcctttgttgggggatgaggagtgtcttgggtcgagaacaggcccctgtaacccactgagcgccccttcattccgtctctctccgccctttgtagagggtcaccatgaagttcaatcccttcgttacctcggaccgcagtaaaaaccgcaaacgtcacttcaat

SEQ ID NO: 12784 - DNA, 736 bp, Homo sapiens
gcaggcttttgctgtctcctgatattgcagtttcaacatgagaggggcaggaaatagaagccccatgcgttgaaggactgctgtgcctgcacttatctctggccagggagtccttggacactgttttctttggcagccagctggtctaggtcacttgaattcctttgaagttcagggatacagggagcggtagccactgcctgcattccttactcaggaggcaggcatggggtctgccattgcttacctgccagagaaccaggccttcattagaaaggtcatttttatgtgactatgactgaatagtccagccttttccccttaagtgggattttgtgctgattcagcagtaaagaataagcccataccccccatttttgttgccattgctcacatttgaatttataggtggagaattggtgaagaaaacgtgatgtagatgcccatcccaaaaggagcaagatctgctcttgcagtgggtgttgagaggggctgggaggctttttcagtcaaatatggagctgaaaactgtcagaatgtgctggttgtacattatcaataagaatcctaacaggagcacagtgtgatttctcttcgtagtgggcgtacatggtccttgggtttccatgtgcagcagtgagagttggtctccaaagcagaacggtcagcattaacttcagccaagcaagcattctgtatggggtgctccctttaagcccaagggaaagcaggctct

SEQ ID NO: 12785 - DNA, 737 bp, Homo sapiens
gcaggcttttgctgtctcctgatattgcagtttcaacatgagaggggcaggaaatagaagccccatgcgttgaaggactgctgtgcctgcacttatctctggccagggagtccttggacactgttttctttggcagccagctggtctaggtcacttgaattcctttgaagttcagggatacagggagcggtagccactgcctgcattccttactcaggaggcaggcatggggtctgccattgcttacctgccagagaaccaggccttcattagaaaggtcatttttatgtgactatgactgaatagtccagccttttccccttaagtgggattttgtgctgattcagcagtaaagaataagcccataccccccatttttgttgccattgctcacatttgaatttataggtggagaattggtgaagaaaaaaaaacctttgatctttggtacaaatacagctgtggggctgttgcccacatttgccgtgatgtagatgcccatcccaaaaggagcaagatctgctcttgcagtgggtgttgagaggggctgggaggctttttcagtcaaatatggagctgaaaatgtgatttctcttcgtagtgggcgtacatggtccttgggtttccatgtgcagcagtgagagttggtctccaaagcagaacggtcagcattaacttcagccaagcaagcattctgtatggggtgctccctttaagcccaagggaaagcaggctct

SEQ ID NO: 12786 - DNA, 791 bp, Homo sapiens
gcaggcttttgctgtctcctgatattgcagtttcaacatgagaggggcaggaaatagaagccccatgcgttgaaggactgctgtgcctgcacttatctctggccagggagtccttggacactgttttctttggcagccagctggtctaggtcacttgaattcctttgaagttcagggatacagggagcggtagccactgcctgcattccttactcaggaggcaggcatggggtctgccattgcttacctgccagagaaccaggccttcattagaaaggtcatttttatgtgactatgactgaatagtccagccttttccccttaagtgggattttgtgctgattcagcagtaaagaataagcccataccccccatttttgttgccattgctcacatttgaatttataggtggagaattggtgaagaaaaaaaaacctttgatctttggtacaaatacagctgtggggctgttgcccacatttgccgtgatgtagatgcccatcccaaaaggagcaagatctgctcttgcagtgggtgttgagaggggctgggaggctttttcagtcaaatatggagctgaaaactgtcagaatgtgctggttgtacattatcaataagaatcctaacaggagcacagtgtgatttctcttcgtagtgggcgtacatggtccttgggtttccatgtgcagcagtgagagttggtctccaaagcagaacggtcagcattaacttcagccaagcaagcattctgtatggggtgctccctttaagcccaagggaaagcaggctct

SEQ ID NO: 12787 - DNA, 193 bp, Homo sapiens
cgcccggacagggactagagttacagcagtgatgactgtggccttgcagtgacccttcatcactcacaaacaaaatctgcctgcactagacgactatgtactggcttagagactaacggtcataattcctattccaagtgtgcagttcatcacggtgcatggaagacaggcatctatctctattcctccccca

SEQ ID NO: 12788 - DNA, 239 bp, Homo sapiens
gcctttaacggcagagatggggttatttttggccctgtctacctcctagttatcaataggctaatcattaattgctaattgaggaatgttagggagattatcgtctcactgttggcataaagaacaaaagagaaatttgattcaactgagattctaaagtgtttgaaagtgatctggaataaagggcacataagatgtggcccctgccttcaaggaaatcgtcgtctagcaaaagaaaa

SEQ ID NO: 12789 - DNA, 1107 bp, Homo sapiens
gggcctggcacccgcgggcggccccagcctcagtctccagctacctttgcctcctgcggccgcccccaggcagagctgcgatcccaccgccgggggtgcagggagagggaagatctggcctccttggtccttttgcgtgggctcttcagagcgtgagcgccggggagggactccggagaaaagcttggggggctgcgtattgctgctccccaagctgggcgtcaggaccaaccccgccgcccccacgggcctgacgggagaggaggaagggctcgggacggtcggctcgccgagccaaccaggtggcgcctgaagagctgtccatggtgtcgacagcccagcaaacggcaccgagttcctagtctgagtgtctggataggtagcagaagaaaaactaatgcctgctctgggacagttctgttcggtgccttttcttgtgtgttctggagctcacagggttctatcgaagagtgcttaggtgtatacgatggagagtgggacgtcacaaaccaggatctcaaggctgagtccaacaaaacatggccgtagggaggccacgacagctgtggttgtcaccgacggatgaatagcttttgccaaccgtggaatttagtaactaaaggcacctaacccttttatctcatcctcatttttcaacaaatggtgcttcctggctaatatcagcgtgtcccatagatttctgcttccattgaatagacctaataagaaagagaatgaagtcaaagccaacagggcagaaagaaattgaaaacctgaagaacccagcactcaaactgtcttccacttgcgtttgctttttctttacctcttctccttctggttttcaacagccaaagcaggatttaaatttggttatgttgcaaaaatcatttccctcttcaggccctgtcatgtgacttgattttttcgtccattttagagaagctgtacccaccctggtttcaggacacggaactaaatttattagaaaagaagccacttcaagtcatgaaggagaaacacaaagattcttggatttagttctaagaactagaggggatttctatgtcagtactgtctcagaaaaaactgttgatatcaaatgtg

SEQ ID NO: 12790 - DNA, 557 bp, Homo sapiens
gagcaaagtcagttttcaatacatgcaggtcctataatgtcccagattatcgaagctgagctgcagatttttgatctttctcatcaaaaatcctctgatctttctgacagcaaaagagaattcaaagagaagtctttcaggagattaaaacattgaggttcaagtggacagtttttcagtggtcttgcttcatccagagataagattcagagtatccagaagaaggctgaatggtctgcatgcccttaacatagctctgcttgaacaattccctcctttcatctgtggtactgcacatgaaactgtcactcactctgcttccttgctgacacttggtgttgtcagactttagacttcttgccaatctaacttctgtgaaaaccctgtcattttaatatgcatttttcagattactaatgagcttatatatcctatatttatgggttttttgtaaacaaattactatttttgaatcatttttctatattatttttaaggctcttgtatatattttggagaataattctatgtgtattatatttgttaccaactctcca

SEQ ID NO: 12791 - DNA, 414 bp, Homo sapiens
gatgtgtagatgttccttttatattctgtttactcattgttgacgattataggttgcaatacctgctcccagatttagtttatcatcttacttttaattgaattatttgatatataagaaattccaagtccaagcatggtggctaacacctgcaatcccagcactttgggaggccatggtgggaggatcacttgagtccaggagtttgagaccagctgaagcaacatattaagactctgtctctaccaaaaatacaaataagttagctgggcatggtgatgcactcctataatcccagctactcaggaggctgaggtgggaggatcacttgagctctagaggccaaggctgcagtgagccgtgatcatgcctctgcaccctagtctgggtgacagaaggagaccctgtctcaaa

SEQ ID NO: 12792 - DNA, 469 bp, Homo sapiens
ggagcccgggagaggagaggcagggttcctcttttagccagaggagcccaaagtgacaggaggacgtggccgcagcaggggttcaggggctccagcacgccgcacgccggggatgtcaccaacacccacttaggccatgggaagccatcagcttccagattctgaacacagagttttatggtacccttgacaagagcagttgtaaagaagcatttaagtaagcattttccccgggtgaggagaatcggcacagcttgaggtgtgagacactggtacttctgtgcaaaacccgccctgtggacagtgggtttgtggtatcctaaggctgggaaggcatcttcggaggttttctccttgctgcaaaaacgcctgtcactgcccagggatacatattttgacctcatccttcctatttagaaactcagggcggttcccgccccgtttgggcagccagagacctcagggttgg

SEQ ID NO: 12793 - DNA, 362 bp, Homo sapiens
ttctatttttttttctacccatcatactactgtatttaccaactataaaagctcacctgatgtgaagccctttcagacaccattcagcctttctcaactcaggtttcttatctgaactgcaacacaggaaattgtttgagtgactgtcttctcgattctccaaagatagtacataacctggatcatcctatgttcttgggaaagaaagtgatccattacatgcaatggatgctgcggggcagtaggacttaatttctcaggaaagcctggctgagaaacatgccacagtaatccagtacacctacaaattatgaacacatcaaattgttcttaccacacacacacacaattccaaaaaaaaa

SEQ ID NO: 12794 - DNA, 633 bp, Homo sapiens
cattaaaaaagaagtatgatgttcctaaacaggcttgatgctggtctgcccaaatggctataaatatgcctgactttaccttaaggattttttttccattgtgttggaggcctgaatctgtgacatttctttgcatctaaaacgcatcagctgattccctttctactcactcaaaatccaccaacactgtcatcaaactcccttatacatattccaaataatatgctgtcttacactgcaagagacatctttcctggttgtttgaaagtacctttttaaaatgtacagatgtgtttggacactcttttggtttctaaagcataacgtccactacatttgctgaggcagtgctaaacctgagcttttaaaccttttcgaagaggtttaattttctgcatcttggatctgaaaccactttgcacttgagagagaaaaaatcatttcttaaagaataaaaaacaaaaaaactccacaatccttttatgttacctatggttgagttggatctaaaacgattgattttatatactgtggggttttgttttcattgaaaatatctgagggtttttgctttatttggaaggtgctctggagtctgcagccagctccaagcagtagtggaggaggctgcca

SEQ ID NO: 12795 - DNA, 1512 bp, Homo sapiens
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtctccattcccatgtt

SEQ ID NO: 12796 - DNA, 1153 bp, Homo sapiens
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggggaaagactatgtgagacagagggagaaaacagccattgacaactcaaggagagaggcctcggggggaaaaaaagatcaacctggccaaaaccttgaaaatccggcttcttgacttgtgagaaaataaatttgtgttccttaatccaca

SEQ ID NO: 12797 - DNA, 466 bp, Homo sapiens
catctatatgttcatatagtgcctaagacccagtattttccatatctccaagtcagccccaaagttagtggatatccagggtggtatatgagctaatatgaataacagctattgaggggtttctggttggattggtgacaatgtagggtagaaagcaatgtacttttaataattctttctacttctctcaatatggagaatatatatttgattttatatacctacatagaattttattatgttgtttactttctaggttactgacattaaaagaattatttctgcctgaaagatttttaattcttgattccttttttcctgtttattctttctaattcacccactcaatgacccagattacctatatccctagtgagtagcccccacaaaaagacactctgcaaaccaggtaaacagaaaataaaaaaccacgaaggattttttttttttttttttttgccaaact

SEQ ID NO: 12798 - DNA, 1957 bp, Homo sapiens
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtctccattcccatgtttttccctggtgtcatctttttgccactcaaaatcagcccattatttccttacaaagatggtgaaaggctgtatcatcatcttgtcgtaagtacgatgagcctgattataagtacctggagttcttaaaaatatggaaccatcagccccagactgcatctactgaatcaaaataacagggatattttttcataatttttttcttcaaaagcaaacttctaaattgattttgatggttatcaatttgggaatcacacaatcaactaagaatgaaaagatatggtctatattctacaggggaaagactatgtgagacagagggagaaaacagccattgacaactcaaggagagaggcctcggggggaaaaaaagatcaacctggccaaaaccttgaaaatccggcttcttgacttgtgagaaaataaatttgtgttccttaatccaca

SEQ ID NO: 12799 - DNA, 1459 bp, Homo sapiens
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggctcataggtggaagggacttgccttgctcagataagactttggacatggacttctggattaatgctggaatgagctaagactttgggggactgttggaaaggtgtgactgtgttttgaaacgtgagtacatgagattcagggggtaccagggatgaaatgatacattttggctgtgtccccacccaaaatctcatcttgaattgttatccccataattgccacatgtcaagggcaggaccacgtggaggtaatcagtgagtgatagtgagtgagtctcatgagatctgatggttttgtaagaacctggcagttcccctgcttgtactcacactgtcctgccaccctgtgaagaggtgcctgcttctcctttgtctcctgccatgattgtaagtttcctgaggcctccccaaccatgaggaactgtgagtcaattaaacctctttcctttacaaat

SEQ ID NO: 12800 - DNA, 287 bp, Homo sapiens
gaatattcagtatttattttcctaacaattactaaacacaccagcaatgttccacacacgagcaggaaaatcaactcactgaaaataaagaaccaccgttttctacaatattggttcgctaattaagtttttctacccacaatttctaggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaat

SEQ ID NO: 12801 - DNA, 437 bp, Homo sapiens
atagtcatgacaacataggttgattatacaggtgatattttatatttactttagtttgcatttacccaattgtataataaaatggagactaaccatttgtttcattgtagcattccaagaatcaagcactacaaagtgatgagcgtaggacaaaactacactattgaactggaaaaacctgtaagtaactatttttgttgttgttgatgaacttcctcccgattccttatagcctcctagtgctggcaaaaagcagccaagttaaggagccctgaatgtggcagatatacaaggtgaaaagtgagattcaggaacaggtggtgaggcagagtaaaatataatttgcttctaaaaattctttccacttttctttttctgcaaatttctcaaggtttgcagagaaagaaaagtggaaaaaattcagagaaagaaagata

SEQ ID NO: 12802 - DNA, 898 bp, Homo sapiens
aagcgattctcctgccttagcctcccgagtagctgggattacaggtgcccaccaccacgcccagctaatttttgtatttcagtagagacgaagtttcaccatgttggccaggtgggtctcaaactcctgacctcaggttatctgcacacctcagcctcttaaagttctgggattacaggcgtgagccattgtgcccggcccataaaagaactttattatatttctaaaattcaatcatatggaagaatctgttgagcaggttagcctttgcttaactttcctcctctgttactccagccttagctggggtgttttgtagaattttcagagcatgggagacagacaactagagcttcctcctgcccttggcccatgcttttaggagagcaaaaggcaaaagattgaaaccactgactttagtttcctcaggccctttctttctgagggttaaagaagaaggaaatgtcttctgtggccaagaattcaaggacttgtaggagataagtgaaggctattacagggattttgtcctggtttggtaggtttctcttggagaaataccactacaccctggtctagaaatgagttttgaagacttggggagttaaagggcactgagttttgctctcactgtaccctgattccaggttttacatggagaaataacctgagggactttatttctatccaatgccctggtttccatcctgaccagaggatgatgacatccgctgataggccatgcttctgtcttctcttatgtgcctcatgccaagcctcgaaatataccttctggaccatcatttccacatctaccttgtgactagaagtcctagttatggtattttgaaatttatgatccataatccttgccagaaatcctgcagcgaactatggc

SEQ ID NO: 12803 - DNA, 483 bp, Homo sapiens
tatcatcgagctcggtccccccttaccgatggcccaggtgaactctaatattgatggtttcacagaattcaaggacttgtaggagataagtgaaggctattacagggattttgtcctggtttggtaggtttctcttggagaaataccactacaccctggtctagaaatgagttttgaagacttggggagttaaagggcactgagttttgctctcactgtaccctgattccaggttttacatggagaaataacctgagggactttatttctatccaatgccctggtttccatcctgaccagaggatgatgacatccgctgataggccatgcttctgtcttctcttatgtgcctcatgccaagcctcgaaatataccttctggaccatcatttccacatctaccttgtgactagaagtcctagttatggtattttgaaatttatgatccataatccttgccagaaatcctgcagcgaactatggc

SEQ ID NO: 12804 - DNA, 578 bp, Homo sapiens
  misc_feature (492)..(492): n is a, c, g, or t
  misc_feature (576)..(576): n is a, c, g, or t
aatcagctcccccagaaatgagggggtctagaggcaggcagatggagaggacagggacttcatagcatttaacatcattttaccatctttccttcctgttctttttggtgctgttggaaatcagtagtgagaggaaaacactcaaatctggaagtctagcgctgtcggtaggaactgggtagaaaaaactatgcatgtccccccatcactcggaaactacatcagaacatcataggagcatcctgtttccatgtgcattagtttccacgaacatacatgtgaatgttttcccacctgtagtgttgctgtggagttgtgagatgtcaaagtggaggcaagagtatctgccttttgcagtaggctctgttcttttcctgtcctgagagaggaggtcagtctaaccctcaccttgtgagttcagccttatactgacctgagcccagggtggatcagatgctgagatcatgtaactttgaactcccagcacattgngaggtcaaggcaggtggatcacttgagcccaggagttcgaaaccagcctcggcaacatggtgaaaccctgtctttacaaaaaanaa

SEQ ID NO: 12805 - DNA, 260 bp, Homo sapiens
acaggaattagaacttttctatgtctataccatcaatgtctagcactgtcctctcactccatgtggcatgtacttaaaatatggcataaaaggataaatctgatttttgtagaatttcctaatagtgtgaaaatgctggtgtgtatgttatcatactgaagatatgtttctttcatgacagctctcattctcagaggactgtgatggtatcatgatatatttctaatgctatctgtggtagtaaagatgtgtcaaagagg

SEQ ID NO: 12806 - DNA, 213 bp, Homo sapiens
tctgacacttatacagtaaattgtttatctttaaattggatctgtagtattttaaaaacttgttgggctgggcatggtggctcacgcctgtaatcctagcactatgggaggccaaggcgggtggattacttgagatcaggctgttattgaactcctgacctcaggtgattctcctgccttgacctcccagagtgctgcgattacaggcgtgag

SEQ ID NO: 12807 - DNA, 2786 bp, Homo sapiens
  misc_feature (102)..(102): n is a, c, g, or t
  misc_feature (966)..(966): n is a, c, g, or t
  misc_feature (1244)..(1244): n is a, c, g, or t
  misc_feature (1627)..(1627): n is a, c, g, or t
  misc_feature (2090)..(2090): n is a, c, g, or t
tttctagttctgtgcataggtgctgccttcctgggggtaggcacttctgtgagtccctgctgcaggggcagaagtgcatgtctgctgcaccagaagcccccnctattgatgctctcggctccattgggagagcagctgccaactcagcttcttctacctcctagatcctcaggcagcaagttccaccggtaccagcgtcctggcccacgggtgggcgttcatctgcataagggtagcagtgagattcgggaagccggtggcccacagctgtggccacagtgcccccacccagtggaccttgatgtcctgaggaccacacagcactgtttacaatctgagggacccacatctgtgcacctatcctctgtgtgattaaataagctgtcaggggccctcagagatgtgtccccatccacacatcatggagcagattcccggctggtcagggtgttaagattctctggagaacccggctttccttggagactttgctcaacagaggaaccagttgccattcaccaggttgaaggttcccctgaggttgcatggtgaccaccaggggcaagcacagcccggcgcagctgctcagggacagcagtctccccgggcctcctggcctctccctccatgggctgctaacccttgccgtagcttgggtttgagtgtcaagcacaggccagaatccacactcctgtccccacctgtcaatcacttcagacacaggttccctccttccaattccaaagctggaacaagggcaggaagaggcgtctcagggaacccccgaagaccccactgtctctccagctcctttcttagaatcctcctcttcttggggagaccaaaggggatgagtagggaggggttctggcttatttacttcttagtttagttttttgtaagtaaagtggccggagagatgagtaatccaaatacgattcctcaggccgggcacagtggctcacncctgtaaccctagcactttgggaggccaaggcaggcagatcacctgaggccaggctggtctcgaactcctgacctcaggtgatccacccacctcagcctcccaaaatgcttcgattgcaggcatgagccactgtgcctgtccaagaaaacagatttcttgatggaaattagtgagacagacatccccttaggattgaaagagagctctgggctgctccagggaaagccacttggcagaaatagcctctgtaagtgaattctggattcccctgaagacnttacagcaaatctctgggtatgtctctggtaaagaccctcacttgagcttctagaagggagcgaaaattcaggaatttgcttgctgcaaaagagaacatgattaacaggtaaaagagaaaagacaatataggccacagaggaatagtgttaggatcaaccctgctcagcaggggcctctggagccctccctgctgtacccaagccagagctgagacatggctccccagatggactggctgtggtcaggaaaggcctgtagagggagctgagggctcagaaaatacctgctccgggtgcctgggctcaagttctcattccatttctttgatgccactggccactgtatctgcttttgtaaaaacctccaaaaagttatacatcnggtatctctagtcagcttcctccgctgcccacctcttgccacagatgagtgatcactgtgaatggtggtgaccaggtgggcagggcaggggcttgtctaagtgccttagcccaggcctctggcccatcgacctcgaaaacagcaatatcgcctccttcttagatccagttaccaagtcagtctagctgggtgggtagtgctcagacagaaaggctggatgggaaggaagtcacatcctaaaagtccaggagggggccaggcgcagtggctcacgcctgtaatcccagcactttgggagaccaaggtgggcagatcacctgaggtcaggagtttgagaccagcctggccaacatggtgaaaccctgtttctactaaatatacaaaaaaaaaaaatagttggatgtggtttcgtgtgcctgtagtgccagctactcaggaggctgaggcaggagaattgcttgancccagaaggcagaggttgcatgatgcaatcatggctcactgcagcctccacctcccaggctcaagcgatcctcccacctcagctccctgagaagctgggaccacaggcctggctaaattttgactttttgtagagacaaggttttgccatgttgcccagtcagatctcgaactcctgggctcaagcgaggggctgttacatctgatcagggcaaaaggggctgtgctccttggacactttgcacagccccagtgggcttctttctcctctgttagtgtggttaatgttcatctgcctgcatccctgagtcacccaagtgtaacctcagccataacacgtactgcagccggaacggtgtccgcagctcagcgtccctctcccatgcactttctgaactttggtcttttaaccaggtttaccagccgctttctgcctctttgtgcttttgagggttttttggtttgtttgttctgttttgtttttaaataaagatgattatttggcccaggctgagggtgcaaacagaactcttcacgtgtccacgacaagaaaaatagtttttacaaacttctagttgtggcatcaaaagtgtgagtttttgcacctgcaaaattgtaatgcaagccctgactgggtggaagctgaagtcttgctgttttaaattaaataaataaattatttttctcctaaaaaaaa

SEQ ID NO: 12808 - DNA, 2950 bp, Homo sapiens
  misc_feature (102)..(102): n is a, c, g, or t
  misc_feature (966)..(966): n is a, c, g, or t
  misc_feature (1244)..(1244): n is a, c, g, or t
  misc_feature (1627)..(1627): n is a, c, g, or t
  misc_feature (2090)..(2090): n is a, c, g, or t
tttctagttctgtgcataggtgctgccttcctgggggtaggcacttctgtgagtccctgctgcaggggcagaagtgcatgtctgctgcaccagaagcccccnctattgatgctctcggctccattgggagagcagctgccaactcagcttcttctacctcctagatcctcaggcagcaagttccaccggtaccagcgtcctggcccacgggtgggcgttcatctgcataagggtagcagtgagattcgggaagccggtggcccacagctgtggccacagtgcccccacccagtggaccttgatgtcctgaggaccacacagcactgtttacaatctgagggacccacatctgtgcacctatcctctgtgtgattaaataagctgtcaggggccctcagagatgtgtccccatccacacatcatggagcagattcccggctggtcagggtgttaagattctctggagaacccggctttccttggagactttgctcaacagaggaaccagttgccattcaccaggttgaaggttcccctgaggttgcatggtgaccaccaggggcaagcacagcccggcgcagctgctcagggacagcagtctccccgggcctcctggcctctccctccatgggctgctaacccttgccgtagcttgggtttgagtgtcaagcacaggccagaatccacactcctgtccccacctgtcaatcacttcagacacaggttccctccttccaattccaaagctggaacaagggcaggaagaggcgtctcagggaacccccgaagaccccactgtctctccagctcctttcttagaatcctcctcttcttggggagaccaaaggggatgagtagggaggggttctggcttatttacttcttagtttagttttttgtaagtaaagtggccggagagatgagtaatccaaatacgattcctcaggccgggcacagtggctcacncctgtaaccctagcactttgggaggccaaggcaggcagatcacctgaggccaggctggtctcgaactcctgacctcaggtgatccacccacctcagcctcccaaaatgcttcgattgcaggcatgagccactgtgcctgtccaagaaaacagatttcttgatggaaattagtgagacagacatccccttaggattgaaagagagctctgggctgctccagggaaagccacttggcagaaatagcctctgtaagtgaattctggattcccctgaagacnttacagcaaatctctgggtatgtctctggtaaagaccctcacttgagcttctagaagggagcgaaaattcaggaatttgcttgctgcaaaagagaacatgattaacaggtaaaagagaaaagacaatataggccacagaggaatagtgttaggatcaaccctgctcagcaggggcctctggagccctccctgctgtacccaagccagagctgagacatggctccccagatggactggctgtggtcaggaaaggcctgtagagggagctgagggctcagaaaatacctgctccgggtgcctgggctcaagttctcattccatttctttgatgccactggccactgtatctgcttttgtaaaaacctccaaaaagttatacatcnggtatctctagtcagcttcctccgctgcccacctcttgccacagatgagtgatcactgtgaatggtggtgaccaggtgggcagggcaggggcttgtctaagtgccttagcccaggcctctggcccatcgacctcgaaaacagcaatatcgcctccttcttagatccagttaccaagtcagtctagctgggtgggtagtgctcagacagaaaggctggatgggaaggaagtcacatcctaaaagtccaggagggggccaggcgcagtggctcacgcctgtaatcccagcactttgggagaccaaggtgggcagatcacctgaggtcaggagtttgagaccagcctggccaacatggtgaaaccctgtttctactaaatatacaaaaaaaaaaaatagttggatgtggtttcgtgtgcctgtagtgccagctactcaggaggctgaggcaggagaattgcttgancccagaaggcagaggttgcagtgagccgagactgcaccactgcactccagcctgggtgacagagcaagactccatctcaaaaaataaaacaagtccaggaggggctgttacttctttttagtttatttatttttgtgaggcagggttttgctgtctggagcatcatacccagtctggagtgcagtgatgcaatcatggctcactgcagcctccacctcccaggctcaagcgatcctcccacctcagctccctgagaagctgggaccacaggcctggctaaattttgactttttgtagagacaaggttttgccatgttgcccagtcagatctcgaactcctgggctcaagcgaggggctgttacatctgatcagggcaaaaggggctgtgctccttggacactttgcacagccccagtgggcttctttctcctctgttagtgtggttaatgttcatctgcctgcatccctgagtcacccaagtgtaacctcagccataacacgtactgcagccggaacggtgtccgcagctcagcgtccctctcccatgcactttctgaactttggtcttttaaccaggtttaccagccgctttctgcctctttgtgcttttgagggttttttggtttgtttgttctgttttgtttttaaataaagatgattatttggcccaggctgagggtgcaaacagaactcttcacgtgtccacgacaagaaaaatagtttttacaaacttctagttgtggcatcaaaagtgtgagtttttgcacctgcaaaattgtaatgcaagccctgactgggtggaagctgaagtcttgctgttttaaattaaataaataaattatttttctcctaaaaaaaa

SEQ ID NO: 12809 - DNA, 2935 bp, Homo sapiens
  misc_feature (102)..(102): n is a, c, g, or t
  misc_feature (966)..(966): n is a, c, g, or t
  misc_feature (1244)..(1244): n is a, c, g, or t
  misc_feature (1627)..(1627): n is a, c, g, or t
  misc_feature (2090)..(2090): n is a, c, g, or t
tttctagttctgtgcataggtgctgccttcctgggggtaggcacttctgtgagtccctgctgcaggggcagaagtgcatgtctgctgcaccagaagcccccnctattgatgctctcggctccattgggagagcagctgccaactcagcttcttctacctcctagatcctcaggcagcaagttccaccggtaccagcgtcctggcccacgggtgggcgttcatctgcataagggtagcagtgagattcgggaagccggtggcccacagctgtggccacagtgcccccacccagtggaccttgatgtcctgaggaccacacagcactgtttacaatctgagggacccacatctgtgcacctatcctctgtgtgattaaataagctgtcaggggccctcagagatgtgtccccatccacacatcatggagcagattcccggctggtcagggtgttaagattctctggagaacccggctttccttggagactttgctcaacagaggaaccagttgccattcaccaggttgaaggttcccctgaggttgcatggtgaccaccaggggcaagcacagcccggcgcagctgctcagggacagcagtctccccgggcctcctggcctctccctccatgggctgctaacccttgccgtagcttgggtttgagtgtcaagcacaggccagaatccacactcctgtccccacctgtcaatcacttcagacacaggttccctccttccaattccaaagctggaacaagggcaggaagaggcgtctcagggaacccccgaagaccccactgtctctccagctcctttcttagaatcctcctcttcttggggagaccaaaggggatgagtagggaggggttctggcttatttacttcttagtttagttttttgtaagtaaagtggccggagagatgagtaatccaaatacgattcctcaggccgggcacagtggctcacncctgtaaccctagcactttgggaggccaaggcaggcagatcacctgaggccaggctggtctcgaactcctgacctcaggtgatccacccacctcagcctcccaaaatgcttcgattgcaggcatgagccactgtgcctgtccaagaaaacagatttcttgatggaaattagtgagacagacatccccttaggattgaaagagagctctgggctgctccagggaaagccacttggcagaaatagcctctgtaagtgaattctggattcccctgaagacnttacagcaaatctctgggtatgtctctggtaaagaccctcacttgagcttctagaagggagcgaaaattcaggaatttgcttgctgcaaaagagaacatgattaacaggtaaaagagaaaagacaatataggccacagaggaatagtgttaggatcaaccctgctcagcaggggcctctggagccctccctgctgtacccaagccagagctgagacatggctccccagatggactggctgtggtcaggaaaggcctgtagagggagctgagggctcagaaaatacctgctccgggtgcctgggctcaagttctcattccatttctttgatgccactggccactgtatctgcttttgtaaaaacctccaaaaagttatacatcnggtatctctagtcagcttcctccgctgcccacctcttgccacagatgagtgatcactgtgaatggtggtgaccaggtgggcagggcaggggcttgtctaagtgccttagcccaggcctctggcccatcgacctcgaaaacagcaatatcgcctccttcttagatccagttaccaagtcagtctagctgggtgggtagtgctcagacagaaaggctggatgggaaggaagtcacatcctaaaagtccaggagggggccaggcgcagtggctcacgcctgtaatcccagcactttgggagaccaaggtgggcagatcacctgaggtcaggagtttgagaccagcctggccaacatggtgaaaccctgtttctactaaatatacaaaaaaaaaaaatagttggatgtggtttcgtgtgcctgtagtgccagctactcaggaggctgaggcaggagaattgcttgancccagaaggcagaggttgcagtgagccgagactgcaccactgcactccagcctgggtgacagagcaagactccatctcaaaaaataaaacaagtccaggaggggctgttacttctttttagtttatttatttttgtgaggcagggttttgctgtctggagcatcatacccagtctggagtgcagtgatgcaatcatggctcactgcagcctccacctcccaggctcaagcgatcctcccacctcagctccctgagaagctgggaccacaggcctggctaaattttgactttttgtagagacaaggttttgccatgttgcccagtcagatctcgaagaggggctgttacatctgatcagggcaaaaggggctgtgctccttggacactttgcacagccccagtgggcttctttctcctctgttagtgtggttaatgttcatctgcctgcatccctgagtcacccaagtgtaacctcagccataacacgtactgcagccggaacggtgtccgcagctcagcgtccctctcccatgcactttctgaactttggtcttttaaccaggtttaccagccgctttctgcctctttgtgcttttgagggttttttggtttgtttgttctgttttgtttttaaataaagatgattatttggcccaggctgagggtgcaaacagaactcttcacgtgtccacgacaagaaaaatagtttttacaaacttctagttgtggcatcaaaagtgtgagtttttgcacctgcaaaattgtaatgcaagccctgactgggtggaagctgaagtcttgctgttttaaattaaataaataaattatttttctcctaaaaaaaa

SEQ ID NO: 12810 - DNA, 515 bp, Homo sapiens
cagtatggagatgacactaacgtgatggggctcaagaatcagatggtagaagaccagctgggaggtgaagtctcagtaggctaggggcttaatgttcgatgcacaccagacttctgagactcaggaggcgggtgtggatctgtctgcccagtgcctctcatttacagcctggacaccctatttcttgaggtgaactactgaaggcttttgtacgacgtgtgtcaggcaagactctggccagaccctttgccatagtccatttgtaatgtatttccacatggcacaggtatctccacttttgcccatgctctcatgtggctcagaattattctccctactgccactcttctttgccaacacagaagatatttcaagatgtagccctaagcttctccatctaatcaataacatgagggctcatatgggaacattgtcacaggcttacaggaatatgttcttaaatatctgcttttttattactctgttcattaaattgacatttatatcatcaccat

SEQ ID NO: 12811 - DNA, 564 bp, Homo sapiens
tttataaggtagtattaaggtcgtactaaaaattacattttaaaaacagctgacagtttgacagccacaaacctaactttttcatatgtatttcctgtgaaagtaaaaccaaaaatggtctttgggccaagaatgtgacttgagccaatttgttaaccaaaaatttatagaatgtccactttgatgaattctcctacccaaacaaacaaaaaacaataaatgactttttgggatggtatcacaaagctaacattttaaaaacaataactaggccgggtgcagtggctcacgcctgtaatcccagcactttgggaggcctaggtgggtggatcacttgaggccaggagtttgagaccagcctggccaacatggggaaacctcatcgctactaaaaatacaaaaaaaattattagccgggcatggtggcaggtgcctgtaatcccagctacttgggaggctaaggcacaagaatcgcttgaacccgggaggcagaggttgcagtgagctgagattgtgccactgcactccagcctgggcgacagagcaggactctttctttgtctc

SEQ ID NO: 12812 - DNA, 410 bp, Homo sapiens
ggaattttcagcatttaaattgtcattaccgccatgggggtgaatgagattgcccagagtattaagttaaaaaagaaggatccaataatgaaatcctatatttaataccgatgtataagaagcaggtagaaggaaagaaatgctgaaaggaggcttagaaggaatggccagggagggagaagcagaaccaggagaagtgccaaatgaaaggagaacgtggaaaaggatatgatgtctaaatcagttcagcatcattaccagtgtcctcttcatctacagctgaggctgcagtcacgctatcaaacatacctcctgagcctgctcccagacccagggaatttttttttttttaaagacagagtctcactctgtcgcccaggctggagtgcagtggtgcgatcttagctcac

SEQ ID NO: 12813 - DNA, 235 bp, Homo sapiens
gcatattgctagaggagagcgccactgcagaggacacactgtcttggccaccggctttgcaaaccatagtggaggagggagtttggggtcaccaaccacttcctggctgactgcctgagccacattatacaagactgtttgttgacttagtaatactgaagccagagctcaccaagattctgacatcaagcatgaaagtgctgggaaatgaaagaattagtcactttacatggtg

SEQ ID NO: 12814 - DNA, 551 bp, Homo sapiens
gcatattgctagaggagagcgccactgcagaggacacactgtcttggccaccggctttgcaaaccatagtggaggagggagtttggggtcaccaaccacttcctggctgactgcctgagccacattatacaagactgtttgttgacttagtaatactgaagccagagctcaccaagattctgacatcaagcatgaaagtgactaattctttcatttcccagcactttgacaaaggggactctcttaaaactcctcatcggacgttagtggaagtcgactcatgtatctaaacatgtagccagcgtaagttcttcgtcagattgatctaatgacttttttagcgtgtgtgtgtgtgtgtgtgtgtgtgtttaatctttttaagtttgggtgaagtttgaccttctagaattcctgtttattcctgagcaaagaaaaaaaaaatcaaccctttttaattcctttagcatcatatctgaccatctttagggtgttatttctttcctagactgaatcactcagagaaataagattggccaacaaatgtaatttga

SEQ ID NO: 12815 - DNA, 479 bp, Homo sapiens
gcatattgctagaggagagcgccactgcagaggacacactgtcttggccaccggctttgcaaaccatagtggaggagggagtttggggtcaccaaccacttcctggctgactgcctgagccacattatacaagactgtttgttgacttagtaatactgaagccagagctcaccaagattctgacatcaagcatgaaagtgactaattctttcatttcccagcactttgacaaaggggactctcttaaaactcctcatcggacgttagtggaagtcgactcatgtatctaaacatgtagccagcgtaagttcttcgtcagattgatctaatgacttttttagcgtgtgtgtgtgtgtgtgtgtgtgtgtttaatctttttaagtttgggtgaagtttgaccttctagaattcctgtttattcctgagcaaagaaacaacaccctaaagatggtcagatatgatgctaaaggaattaaaaa

SEQ ID NO: 12816 - DNA, 282 bp, Homo sapiens
tggcggcaaagaacagaaatctactctctcccagttctagatacagaaatctgaagtcaagatatgggcaggaccacacgtcctcctgaggctctaggggagggtccttcctgcctctcccagctcctgggggctccaggcatccctgggcttgtggccgcatcactccagtctctgcctccgtctccatgtggcctcatcctctgtgtctcctcttctgtcttttagaaggacatctgtcgttgtatttaggacccaccctaatccaggatgatctcatct

SEQ ID NO: 12817 - DNA, 795 bp, Homo sapiens
caaaaaccaagtacatttgctgatactttgaagaaatgttttaatgaggtactatttacagagatacaaccagatttaagataactaacaaggattgtagaggcacctgtggactaaaagacattagctctggagaccaagttctggagactaagtggtctggaggaagagacaagagtagttgagcccagtggagagttggaaccatgaaagtgagactcctaaacagaagctgcagttcagtaaccatgccaataacgaatgaaagcagaaaagaaatagaggaccacatacttccacctctttccttctgcagtatgatcacctactgataaccctcattggtcaaacccagccaggagccagaaagcaagggagagtagctgatgcgtttggtagagtttggcctcccagagcacagagcaggactaagatgaacagagaaaggatctagagggaaatggtggataatcagttttttcaatgggtttttaaagattttttaaactatatttctgaaatgtgaagataaatattttatctaaaattgggcaagataactgtatggatttttttaacttatatatggctacttgaaaaggaattatgcttctctttaatacagcaggattctctggttataaaagtgttttgacataccgtgttaagagtaacatgggtttaagtcatgtacagagagttcggaagagaaatttagatacccaataaaaatatgacaaaatcgttgacctcgttattaatcaaagaaaaaattaaagagtaaattaatcaaag

SEQ ID NO: 12818 - DNA, 671 bp, Homo sapiens
  misc_feature (643)..(643): n is a, c, g, or t
  misc_feature (647)..(647): n is a, c, g, or t
ctctccaatcactttttaatttccaggggaaatcgtaatctcactaatcacctagaaaggaatgtggagatgggagtatgaaggacgcagttcaggccttgaggcccagcgggcgtttgttttagtcaccgcatttgctcaaatgctttgtgcccgtggttaatgctggggagtattggtggaccctgcctctctgtctctcagagtccccttggagaccttcactcttcacttcaaggctgtgtgtgctgcccagctctggtgctggtgacatcagtggaaagagagccacaggtgctgtctggtccctcggaatctcttctctttattataaagtaccgctggaggcagagaaagagatttttgagctttccttctagcccacaaagctcagttttatttggagcttttaaccttgagccttagccagcccctgatgtgtggattttagaatcagtgtgaattttagggagatagggaaggcctgcagaagtttgaccactgcttcttgagcacctcttgctgtctttttctttttgaggagggtgggggctcctttagaattatgctggcatggtgattcttttttcttcttcttctttttttgagagacagagtgtccctccagcctgggcgacagagncgantccgtctcaaaaacaaaaaaaaac

SEQ ID NO: 12819 - DNA, 829 bp, Homo sapiens
ctctccaatcactttttaatttccaggggaaatcgtaatctcactaatcacctagaaaggaatgtggagatgggagtatgaaggacgcagttcaggccttgaggcccagcgggcgtttgttttagtcaccgcatttgctcaaatgctttgtgcccgtggttaatgctggggagtattggtggaccctgcctctctgtctctcagagtccccttggagaccttcactcttcacttcaaggctgtgtgtgctgcccagctctggtgctggtgacatcagtggaaagagagccacaggtgctgtctggtccctcggaatctcttctctttattataaagtaccgctggaggcagagaaagagatttttgagctttccttctagcccacaaagctcagttttatttggagcttttaaccttgagccttagccagcccctgatgtgtggattttagaatcagtgtgaattttagggagatagggaaggcctgcagaagtttgaccactgcttcttgagcacctcttgctgtctttttctttttgaggagggtgggggctcctttagaattatgctggcatggtgattcttttttcttcttcttctttttttgagagacagagtgtccctccatagcccaggctggagtgcagtggcacagtcttgactcactgcaaaccccacatcccgggttcaagcaattctcctgcctcagcctccccagtagctgggattacaggcatgcaccaccacgtccagctaatttttgtatttttagtagacaccaggtttcacgacgttggccaggctgatctcgaaatcctgacctcaagcg

SEQ ID NO: 12820 - DNA, 628 bp, Homo sapiens
cagacaggatatgtaggggcttacctagagcctggcacgacttctgagaagtcacccagcagaccggctagaggggatttgtgtgccacactctacttgccgggctgccattaaaatagaaagatataaaactgggtcaccaaaaaaaccaaacctcaaggctatccttccagagcagtagaaatgagtcccacagcctggtctttgagcagaggctgggaagataggatacatcactgtctggataccttctctttttaatagaatatattccgtatgattccctttccaccttaatggaaataatagctctctcctgcctgaacaaaagggattccaggtagtattgtggctaagagattacagcggacgatggaaggttcattttttagggaaggtgttgggtaggaagagtcacatttgacagaattcataaataatgtgtcctgaagtcagaggatgactgcaaagaaacacctcatgattccattaaatataaagagataaggagcaaggaggaaaaaagagaaagaattggtctttatttttcttgctaagaactctctggagtattgaaagacattgaaattatccctaaaattgtcacaacttttgtgaatactggtat

SEQ ID NO: 12821 - DNA, 455 bp, Homo sapiens
ctttctttctttttctttctttctttctttctttcttttctttctttcctttctctctctctctctctctctttcttttctttcttttgagagggagtcttgctctattgcctaggctgaaatgcagtggcgtgatctcagctcactgcaacctccacctcctgggttcaagtgcttctcctgcctcagcctcctgagtagctgagattacaggtgcccaccaccacatctggctaatttttgtatttttagtagagacggggtttcaccatgttggttaggctggtttcgaactcctgacttcaggtgatccacctgccttggctttccaaagttctgagattacaggcaggagccaccatgcccggcctaggtcttacatttctaataccctcatctttgtgtgtatttaacaagtataaaatatccacaagatgcaatgtttacataaattt

SEQ ID NO: 12822 - DNA, 186 bp, Homo sapiens
tttattaaatttctgtttttaagggatggggtctcattctgtcaccctggctgctggagtgcagtggcatgagcatgaatcactgtagtcttgaactcctgggctaaagcaatcctcctgcctcagcctcctgagtagctgggactactcagtgtttacaggtgtataacaccatgcccagctaat

SEQ ID NO: 12823 - DNA, 408 bp, Homo sapiens
atgacctttggaattgccacagctaccttacagcagagaacagggacgcacacagggattttcagagaagcacgtaaggaaaatttgaaatgaagctaaattcaagaagtaaatgatacttagaccttttgcaaagaaaacccagagattttaaaatagacaatagcatgacaatttataaaaatgaagctatttaaacagtatgatgtatagtattcacaatagcttaaaatattttattcccaggagcaacctaatccataactttttttttttttgctaaatgttagatgttgatatttgcaatgcattgccttaaattggaagattataacaaatttgtgtattttatggtgtactgtctatgtattgtctcacagcagctttgattcacttccatattaacct

SEQ ID NO: 12824 - DNA, 379 bp, Homo sapiens
ttcacaaagagcatcgcacagtggatttttacgtagtagtaacaatttgctgtaaaattgtatggtctgaggatatgaccgtagagtttgtcttctgtgtctccaaacttactatcctgtacatcttgactcattttattcatttttcacttcattaaacaataaggatttaccttaaattaagcatttttttggtatgtttattgtctcctagtggtcctttgtaatgccatatggttgctgcccagctcgacttacaaacttactctttttgcttctcatactagccattttgcaagcctgagctgctttgtggtacaggtcaagtacttatggagtaaagttaagtgaatttttattgtgcaggaatgtcttcgtt

SEQ ID NO: 12825 - DNA, 1874 bp, Homo sapiens
  misc_feature (1287)..(1287): n is a, c, g, or t
  misc_feature (1294)..(1294): n is a, c, g, or t
gctggtgggctccaggtgcagagagcagggtgggcgtcagaccccaggtccactgtgcacgccctcttgtagagcccgttccgttgtccatgagatgaggagtgttcttatctctaaagtattatcatgaaaacctaacaatgtagaaagactaaagcacatgggtggtgcttcataaatagtatttctcccactttctgaaaactcctgctgaagtaactgcacaagaatccttgaacatttagaattctggttttagccataccataaagtcagtagtgcgtggtggaattctgctaacgaaaattgcgaaggatcaaggcagagtacagagctggtgtgtagcgggtaccttctgtctgctggcactaggtattttacacattaaatcagctcgttctcacatcagctcttttaaaaataaggaaatgaggagccacagtggcccaactgatgcagtggcagaagtagaatttgagcttgtgcagatgtgcctccgtgttttgtctcctgagcatgctgccccaagtttgacaataccaagatttgtactggaacattccctcccatccccaccccctagaagcccctcttcctcccttagatttgacacatagtttgaaaccactattaactaccttatgagagccactgtttgtgaagtgctgactatgtgccaggtcccgtgccgtgcaatttttgtgaattatctcgtgtctacagtgcctcacaatttctctgctcaatacctccatgttactgccgaggaaagggaagctcagagagagtaagtaatttgctcgagttaaagagctggccaggacagccaggggcttgcaccccggagccttcatccactacactgtcagctggtatctcaaccagccattacaggctgtaaaaaaattatataagatagtctatggtaatgcagaaaagtgaggttattttgctccctttccctttgaagaaaaaagccctggaaagacatatcacttgagtatgggaaaaaatgaagctgtggcttttctgtgagtcaattctttcctggcagcttcttggaataagaccaagtatagcagcagagttttctgttttaatttgagctgcagggtgactttttttcttctatgctttcatctctctgtggcttcttttgcctcgttaatttcatgccctgcccaggcgggctactgtgctgcccagtcacccgggtctggggcggccaccgctggccagcaggcaggccctccagaggcagaggtggccacgcttaggtcgctcccnctgtggnggcggcacacttgggtggcagcacagctgtgatgtggcggcagctggcagccccatgggaaagatgtgtgaagtgtggggtttgacgacccatgggagaacagactttcttcctcttcttgttttcccttcaaagccgtgagtcaacctcaaattctctgtcttttttctccaccccctcgtgcctctctccctcacactctgcatctctcattgcaagcttgcatttttttgcacacaacactatcctaatatttctcttttctgcaggcaggaaatgagaagtcatttttcagggtcattcaggaagtcatccagagttataatggcccattatctaatggtcagagtttacttaggctttcactacttccactgcccacttgaaacagggaaaaatattttccccccgcgctgtgagtgtgctatttagagctgaccacaagcggggggaagagaggatggctcggatgctgcatttccactgagaacacaaggctggcaaagcttgtctgctgcccagcaagcacttcaggctcacaccattttaggttcactttaagtagtttctcaattgttaa

SEQ ID NO: 12826 - DNA, 430 bp, Homo sapiens
atggtcaagttattcctcaacataaaatctcttagaagaactgccatcaaggtattatacaaatgggttgtttgacttgaagaaaaaacaatgtagcattaattccacaaacatgtattgagctcatacctaatgtaccagtgccattgtagttgctaaagatagcaaaataaataaagatttcagttcttggattcaaggagctcagagtctcatgaaggggagagacctaaaacaattaattataacataatgtggtaaatgtacatgctctatatatagaagagagagaaccagtctaacctgataaatgaggggaaatttattaagacccagttttaacatcatgaagaaagagtaggatctagtcagaggtaattgttttatttcaaaccaatgaaacaatgagataataagttgggaaaagttg

SEQ ID NO: 12827 - DNA, 247 bp, Homo sapiens
tgaatgtttgcagtgtgcaccggtctggctgaaggcctcttcccttccccaacaccctcccatcgtgcaaaattaccctgcccagcagggagtgacttgtgtgtctcagaagattttgttgctgtgctctgagttctcactcctcatctcctttgaccagtttcttctaatactccccttgttcacaacacagaacatgagtgctctttcctatcattttgacactaataaacggacagtgattctc

SEQ ID NO: 12828 - DNA, 436 bp, Homo sapiens
ttgcagctaattgattctgcagagaaaaataagccctggtgcctctgacaggtgcagcagcctcgtgcagtatgttctcattatgcttatgtaaagtaagtctctactatcaaatgttaagaaacaacacagtggggcaaattttaaattaatggtttcagaaaatatcctgcagcctcatagtgtatcttgtcagctctctcaaattgtggacattcatcagaggtcttaaaagagaatggcaggaagtcagggaactgaaggtttagtagtaataaatggtatgtaagccaatatatagttggcttagtgttgttctgtgggataagaaatgcttctaaaccaagaaattacagaaaacatgcacaaacatattttttgactttggacagttcatgacggtatccttccaagattaaattaagaaaactaacac

SEQ ID NO: 12829 - DNA, 1281 bp, Homo sapiens
tggtgtgtggatgatgtcgtccagcctcccccatgtcaccagcaaccacgtcagctacaatggcctgtatggagtggcagtatttagccagaaggatggctccagcgagttacctcgaggccacagggctcaagagaacttcagcgaggatggggacgccatcctctgggagacagagctggagaaggaggacgacccactgcgccggcccatcaccatagctcttgttgagtctaacagtattaatcacaatggaggtgagtataccccctcagcccctgctcaagaaccttccatggctccccactgtctttttttttctccaatttaaaacttttaatttaatttaaatttaaaagtaaactttaatgtcaaagatgcaaacctgggtagggcagaaaaatcacacacaaggttgccacttcacacttggagggttgcacagcggccaggcagaggcgctcctcacttcccagacagtgtgggggccagggagaggcgctcctcacttcccagacagcgtgggggccagggagaggtgctcctcacttcccagacggtggggcggccgagcagaggtgcttcttatttttgagacggtgcggccgccaggcagggccttctgcagactgatcccaacttgccctcaggcctcatcagccacttcttccagcctgatccccaatcctcctgtatttattcattaaacttgaatccattctttcctgcctcctaacctgctgacctcactcatgcctttctcccatccacacgtcccaaactaacttgaacttcaaaacctgttgtgaatatcccccttcattccttcctcctttgaactgggccctccccatccccactggcacttgttatgaggcctcgcgactgtatttatttctgtggctgtttcatcaacactgataggccatgaacttgagacaaagaactgaagcccacccagctcagtgcccctgtccctgcagtaccaaatcccacctctggcacacatgcttttaatcaactctaggatacatttctcaaaattcaacatctcccacgagatgcatatcatggtttaattggcagtgagttttccttcttagagaggcagaaaataaaagtgttttaaatccatgttatcctaaacctgatgaaaaatggaggccaggtgccagggatcaagcctgtaatcccaggactttgggaggccaagactgggggattgcttgaggccaggtgttcaagacccgcctgggcaacataacaagacttggtttctac

SEQ ID NO: 12830 - DNA, 2752 bp, Homo sapiens
acactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggatcacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctgggctgtggctcttgggttcacagaatccctaatcctccaagcccctaagaggcagggcagggatgctacccacaatatatgcagaaccccagatggagcctgtggggagagagaggaaattaccgtcttcactgtaggcaaaggagaatggctgtgattagccatatatgcctata

SEQ ID NO: 12831 - DNA, 462 bp, Homo sapiens
  misc_feature (330)..(331): n is a, c, g, or t
acactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggacaatgnncacacttttattcccaacgcagaagcccttgaaaatgtgcttggggttttcatcatggtttttggaaaggaccgatccaaaaggctatcccttataactcatgaaaataaaattgccggacctgggccaaa

SEQ ID NO: 12832 - DNA, 949 bp, Homo sapiens
atagccaagaccacatctctacaaaaattaaaaaaaaaaaaaattagccagacatgatgacatacactggtagtcctagctactcaggaggctaaggctccttgcttgagctgaggaggtcaaggctgcagtaagttgtgatcataccactgtaatccagcctagggaacagagcaagaccccatctctaaaaagaaaagaaatgcacattctcaggtcccatcctcgacccaataaatcaaaagctctacctgagtttcagatttagtagttccgtgttggggttcaacaatgtgtaggggtcctatacgtattagctctcactccttattcctccaacttggtcatggtatataattctttttatagattcctggattttgtttgctaatattttattgaggatttttgcatttatatttatacaggatatatgtctgtccttttcttgtgatgtctttgtctgattttggtatcatagtaatagaatgagctgggaagtgttcccccttctgtttttttggaagagtttgtgattatataccatgatgaagtgggatttattccaggaatgcaagtttggttcaacgtgctaaaaccaatcaatgtaatagattactagcataaagaacaagaaaagcataattatctcagtatatggagaaaaaaacattgacaaaatttaacaatcctttcatgataaaaaaaaaaaccaacaaattaggaatagaagggaacttctcaacctgaaaaaggacacctatgaaaaagcctcagctaatatcatacttaatgatgaaacattgaaagctttacccctaagatcaagaagaagacgaggatgtccactcttaccactcttgttcaacattgtagtggcagttctagccaggggcagttaagcaagaaaaagaaataaaaggcaaccagattggaaaggaaaaataaa

SEQ ID NO: 12833 - DNA, 874 bp, Homo sapiens
cactgcacccactgtcctgcacccactgtctggcattccctagtgagatgaacccggtacctcagatggaaatgcagaaatcacccatcttctgtgtcgctcatgctgggagctgtagaccggagctgctcctattcggccatcttggctccaccgtatccttgttttaatagaagaaaactgtataatatcaatattggaatggttaaatactgttttactcattatattgatattatacattcattagaagatgacttaattagccaggtgtggtggtgcatgactgtagtctcagctactcgggtggctgaggtgggaagatggcttgaggcaaggagttcaagaccagcctggacaacatagcaagaccccatccataaaaaaaattcccagactgacaaagaaacttaaaaaataaaacatagactaggatctcattaacaaattaacattatatatatataacagatgtgaaataaactaccagaaagattctcttctacatcatatgtcaccagggaaatgtgagttaaaacaatgagataccactacctaccaattagagtggtcaaaatccagaacatgctgtggaaaatgtggagcaccaagaaattttatccattgctcatggggatgcaaaatggtacagccacttaccaaactaagcatactttgaccatactctccagcaatcacactctttggtgtttaccctaataaactgaaaatttatgtccacataaaaactggcacataaacatttatagcaggtttattcatacttgccaaaacatagaacaaccaagatgtccttcagtaggtgaatggataaacttggtacatcaggacagtgaaatattattcagtgctt

SEQ ID NO: 12834 - DNA, 443 bp, Homo sapiens
gggttcgggctgtgtctccaaccagccattccctctctctctcccttaggcctctattctgtgagacacaatattgcagttaggccaattaataatcctccagtggcctctaagtgttgaagtgaaaggaagaatcacacctttctcattttaaataaaaaactcgggccgggcatggtggctcacacctgtaatcccaggattttggggggccaaggtggcagatggcttgagcccaagagttcaagaccagcctaggcaacatgccaaaccctgtctacaaaaaatacaaaaattagctggccatgttggtgtgtgcctgtagtcccagctacttgggaagctgaggtgggagggtcacctgagctcagcaggtagaggttgctgtgggccacgatcgtgccactgcactccagcctgggtaacagcaagaccctatctca

SEQ ID NO: 12835 - DNA, 935 bp, Homo sapiens
  misc_feature (605)..(605): n is a, c, g, or t
gcattgcctctgtgggggcaggagacagcaaacataaaacctgtccctgaaaggggcaagatggccccgatggctccctgcacctgtcctggtgcctgcaggcaggcgggtcagctcccctcccgctgccaaatctcccacgtctctgtgcgctctgtcacccctgctttctggcctgagggctgggaagggaggtctggggagcccaggagctgagaagtacccaaaaaccacccccaacgccccccaaccctcaggcgtgcctgtgagtgtgtctgtgtgtctcactctgactcacccagacaactgacttcagcagccaaccttggtcattcccagaaccaccactggggggcatacgtgtggctagactgggggcgcccgaatatctgtctctacaaaaagtaaaaaaaaaattaatggggtgtggtggtggtgcgtgcctgtggtgtcagctgcttgggacgctggggcaggaggatcacttgagcccgagaattcaaggctacagtgagttaagattacgccactgcactccatcctgggtgacagagcaagaccttgtctcaagaaaaaatttttaaatgagtaaaattttaaaaaancaaaaaaaaaaaaaaaaaaaaaaaaaaaccggggttttatttggggggggggaaaaaggggtattgaatttcgaccattggtcaatagcgtgtttcccttgagcccaggtttcttttgtacagggggaacagattcgcagggcccccatagggagcccgattaaattccgatacgccggtaccggatattttgtcgcgccaccacgatggcgcagcagacgcgaggagagtcaccgacaacacgcccacacacacaaaacacacatcgacggacgacagccctgacgcaggacgcaaccaaagagccgatatacggcaggggatccatca

SEQ ID NO: 12836 - DNA, 154 bp, Homo sapiens
taacttggcccagattgtcaacttatgaatcctactgattaaaaattttttcttgcatttctcatcagccatcgaacattggttcatgattatttatagcacttaatgacattgaaagggatttatttcaatttattcagtctttattaacact

SEQ ID NO: 12837 - DNA, 1202 bp, Homo sapiens
tttgcacttgtaatttcccagagttgaaaggaaagattgaactggaatattgtgtaaactatctgtcttacattagtgtagcattttgcaatttggggaacatcttcacaatttgtgtctcgttgttcagaacaaccctgtgaagtagtttggcaatgtctgtgttacatttcatgtaatttagccaactcccattccaactaggctttggctaaatctgacaattttatatatagcttaaaacaaagaatatacattcttttcacccctcccagtctacccatccagccttcatgattcattcctgtgtcaaggttagtcgctgttttccatttgaattggtttcttttatggtcagtttactttcttccctctcccctccctttcctgcacatccccatccttgctatgcctttctgtcctcttttataatggatatatctttttcctgccattatccctcagacattctcctcatggcacattttcttcaaatgctaacatttactgagtgtacattgaagttctgtgcatacaggaagaagttattttctgagcttagataatactatgtgtatatgtgattaaaatgaagattattttctaaagccttcaaattagaagtggatttctgtttcattacttccgttttaaaagtttttgccagagagttttgctaaatactctcttatttgctctagtgtactagtccagtagtgtttgcatgtggatgtctgtggatgacagttattgtagcactttggcagtgcactaaaattttgccactatgaaatgtttctttattgtgtgtgcgtgtgtgttttgaaatacgcacacagccacacccacatatatattaaaagtggttgtattcatttagtgaaaaacaaaaagtagatgtacttctgtaaatcagataaatgcttggaatttgattgtctacccaatcaacagttttccctctttgctctggaaatatttgtactcatatagcatatttcaaaaatgttgtcattcattaaggcctcttaaatagaccactattttttgtgtctggcagatgagtatgtcaaggattgagatgaacacataagtcttggaaattaaataaatttataaacataaagataatttaatgctgtgacttcattttttaaattctttaaaccaactttctcccaataaaaaattataaactatgt

SEQ ID NO: 12838 - DNA, 1843 bp, Homo sapiens
acatccagctgcctgagaccctcctgcagccttctcaagggacagccccactctgcctcttgctcctccagggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatggagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattctaaaccctcaaaacaaaaccacctccacaccctccaccacacaccccaaccgaggccgccccacccactaaaaggtacgcccctagaagggcacccagcatgcttgcggtgggcccgcaggtttatgttgtaaccggagtggccccaaatggcgggcgcttttatagagcccgagcccgtggtcggcggtgtagcaccactcgtgtgagagcaggaact

SEQ ID NO: 12839 - DNA, 1626 bp, Homo sapiens
acatccagctgcctgagaccctcctgcagccttctcaagggacagccccactctgcctcttgctcctccagggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatggagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattcta

SEQ ID NO: 12840 - DNA, 249 bp, Homo sapiens
gtacagactgcttttccagcagcatggacacaagaagcatagtaagatgatgataacccacataaggcaggccctttggaatatgttaggtttcaattggtagtggaatagtgtatttgattatatggttagtacttgggaagcagaatgaagtttgtcacttagaatagattggtagtcttaaaagagagcgtctagggaataagttgaattgcttcacaaaaaggttaattggagaaaaaagtttta

SEQ ID NO: 12841 - DNA, 444 bp, Homo sapiens
aagccaaggatgagttagcctgctgctacccattttagctgcagagtgggctgtgcaggttctgagctttccccatgtgatagtcaaagaccccaaggcagccccagcctctctaggtctctgcacagtctccagtgtggaaagctgtgggaaaggaaggagcaggttctaggtcttcaggattttctgcatcttaaagcagctcatctcctttgccctcctagggagcaggggggcctagctttgggatcgtcctcctagcctcagaaataattgttcaagaaataacatttctcacacaaaggataaatgtttgaggggatggataccccatcttccatgatttgattattacacattgcatgcctgtatcaaaaatctcatatatacacctactatgtacccacaaaaatttaaaatttaaaattaaaaacaaaacaaaac

SEQ ID NO: 12842 - DNA, 464 bp, Homo sapiens
tcatggctatgaggtgatttgtcctttgctggatgactagataaatcagtaaagacagaattcaggaaaagggatgagagatggaatggggaggagactcagatttaaagaatgccttgtgctaggccacgtgctgagcattttctataagtcagttccccaagtcctctgaagaactcaaatccttcagcacatgtttgttccgcacaggttagcagtggtcacaggcaggccctgagggtggactgcctgcccaggttcctgtgctgtgcgtggcgctgggctttgctcagaggagtcaaggagaagtcacttggccccagctctaagaagacttgctgtccaggacaaagattgtcaagctgtttctctaaggttcatagtgagaaatccgttttatgttgcaacctgtaggaacacattagtcccacagtcagaagtaaaacatttcatctcaagaaaaa

SEQ ID NO: 12843 - DNA, 363 bp, Homo sapiens
cttctcccatttaatcttcacatgcttaggtttacgtacgcttacatttatggtttcacactctggccttgatctctgaatcagatctctttgttttaatgacattctgggctacccttctggtttgggactttgggatccactgttatttctgaggtctgattatttgacatatcaggtgcacaggcccatgtgcaaatcctctatcagtcctgactcatgaaacatggctactactcctacccccatcactgaagcctgtcacttcactactggcaaaggtatttagggaaagttcttaccctcctaataggatgaggttgtagagaaccatttacataatttatgcttacgctttctcta

SEQ ID NO: 12844 - DNA, 498 bp, Homo sapiens
aggattgagactagtttaattcatgccgtaacaatttgctattcttctctgaatctcagtttcctcatccttaaaattggaataattttacttgtcctaatttcttcatgagataatgtctatgggaggactttgcaaactgtaacaaaaacaacagatttcaatatgtattgtctgaaactctagtaactggtgggattgagagtaggtagatatgaggaagagttccccacttagtttccttttaggtattgtcatgggcactttttctagttatgagagtaagaacttaggggaggaaataggttttctcaagtatcagggctgttgagtctagttaggaactgtgtaggtagtgaattttgttttcttactttttggtgccttctctctccaatgatgcctcttattctctgtctgtggacatatatcttatgacctgggactcattccagatgtgaacgtgttttctgaatcaaaattgggacatgaagtctt

SEQ ID NO: 12845 - DNA, 524 bp, Homo sapiens
tacccggcaacctccgacccacaccaactccagagccctggcccacacccgagctatgaccatggacagagaattttgtctctttaggcatcactttccttatctgaaaagtggagacaaaaacaggacctacttgctaaggctgatgttaggactccaaggacatggatgaatgaacgtaggcttctcacagggcctggcagtcctccagccagttcagcacacattaacattgaccctgaggaaaaccatatgacctgatgctgtggaacttgtagaaacttaatgcagagcttaagccttcataacaacactgagaaggaaacagtccagacttaaaacctgtctgcttggtgggcaaattcagatatagggtagtagccagaagtgcagccctgagcccttgactgctaggagtgaggcaggggttgggatttaggggatgtcatcctgatggggactctgggagcccagctcatgagtgttgagcttggaaaactttttgttttttagctggaggctca

SEQ ID NO: 12846 - DNA, 587 bp, Homo sapiens
gcactttaggaagcttagagtggggaagtgatggggtggtgggctggaggcagcctgaatgaagagaggaggcagagacagaggctgagcggcaatggtggagctgctgtaagacgatgctgggggctggcaggtggtctaaaaagccctttcctggatccctgtgggtgtgagggattaaagcctacaggtaaagcaactacaggcccctgccacacctcctcaggtgcttaaagagttgcctctgtgttcccagttgtaaatgagatcatctttggtgatgtctggatgataataaccactctttattacacattttctctgtgctttacagggagtaggttctttaatcctcccaacatccctttgcggtaggtgctgtaagtcattttatagatgaggaaattgaggtcttagagaggttagatcatttgcccaagaccaacagctagtcagtggtagaattgggatttgagcacagagacagtctggctacagagcctgtgcttaccgtaaccaccatgcttttaaatagcaatttttcctaatgaaaattgatagtgtaatgtccagaaggttagaattta

SEQ ID NO: 12847 - DNA, 297 bp, Homo sapiens
caaactccagagctcaaacagtctgcccgccttgacatcccaaagtgctgggattacaggtgtgagccaccgcacccggccttcacttttatccatatgtttcgctttggaaattcaagtttgctacacgttcactattcttcataaaataagtctagtaaaatgttgatatatagtcttagtaaaatgtttaacttgttctttgccaaagaataatttgaaaaatgagaaaacctgtcactcccttctttcctccctcctatagccccacctaaaattaaacatattgaacagctg

SEQ ID NO: 12848 - DNA, 193 bp, Homo sapiens
tactttaagttaatgtttatacacatatacagcaatttgtttttttaatgttatcagattaactgaagataatgaattttaaaataattcttgtgatgtaagagggaaaggaaagtaagtgctaaacttagtttaaacttcaacatctgtaagttaatacagccattatggagaacagtatggagggtcctca

SEQ ID NO: 12849 - DNA, 215 bp, Homo sapiens
gtccactggtgtcccacactgcagaagtggtgcatggaacagaggtcaggagttgagatcccgatttggaagttatttacacagaggatgaatctgcaatcatgaagtctgatgaaattccaataggaaaaccatagggggtggggtgggagagaaaagagatctctgagctgaactatagacagcagcaaaatttagggaaaaaggagaaaaaa

SEQ ID NO: 12850 - DNA, 503 bp, Homo sapiens
acaataatcaccaagaaaatctctttggtttttaaaaataaataaacatatattcataaaactcaaaaaacagttatactgaacgttgagatggcagaaactttcagaagcaaaaattaagcatattgaaaggatcccactcatatgaaactaacaggctgttttctgtttaaactcaactgtgagtgcttctgttcagaacacgttatttcatgactaggataaagaagcaaatggtttatgacttgtctgctttctggtagttagaatacaagggtcaatctatggctagtgtttattggtaattttaaaatctttaaaaataagtagctgggcacagtggcttacgtctgtaatcccagcactttgggaggctgaggcaggagaatcgcttgagcccgggacggaggttgcagtgagcggagatcgtgccactgcactacagcctgggaggcagagcgagactctgtctcataaaacaaaacaaaaaaataaaaataagt

SEQ ID NO: 12851 - DNA, 446 bp, Homo sapiens
  misc_feature (413)..(413): n is a, c, g, or t
  misc_feature (420)..(421): n is a, c, g, or t
tggatgttttttagggctataaaaaagttaatttttcatgaaagggcaaactagaccagaagatgctgctgaataagtctttattctattgaaagtaataggcaaaaacctaataccatagaaattgctaagctttttatttcttctccaattttctctctaaggggagagaggtctataaaggcgttcatctgtgtccactttttaaatgacttagtcctgccactgaatttgcctgggggaagagaactcataagtagataatacaccaggagtcaagccttttgaagtcattttgtcgctctctccttttttttgggtgttgaggtgaggataagaggagggcgtgaaaccccgaggcggagcttgcagtgagccgagattgcgccactgcactccagcctgggcgacangaagtcnntccgtctcaaaaacaaaaaaaaaca

SEQ ID NO: 12852 - DNA, 610 bp, Homo sapiens
tggaattgcttctttaaacttgactccctagaaaatatcaattttccatcatgtctcagagcaaacgctgccttctctgagaagcctcccctgattcctccaggccccatcccctttcttcacacttccttgtgaacatgcctcaaaatcatagccgttcccattatgctataactgatttcatgtctgtcccggctccaggctgcagccctagaaggagtctgacttcatttccctcactatcccccatagaagctcagtgcgtgacatataacaaattgctgattaatatctgttgaaagaataaagcaaggagggagggagtgaggccaactgcacagctcttcatagcagaaaacaacagaaagagccttggcatttaacaaacctgagtttggctcctagctctcctgcttggcaagtggtttagccttctgtgcctcactgtccctttctgtaaaatggggacatccatctatctcacagggaagactgaatgaagtgtgtaagcctgaggcacagtgcctgccccatcaacagagtgtgggttattttcatcccttctcctccttgctcctcccctcagataataaaaccctctggtctgatc

SEQ ID NO: 12853 - DNA, 519 bp, Homo sapiens
atccttaggacaaccttttgagggaggagatacggttattaacctcatttaggaaacctttgtaggggagtgaatagaaaatgggacactatggaagtcaaaagtaaggaagtagaaaacaagcttgagaaaaaattttcccaacaaaaggctgaaaatgtagaatatgagaactatggggaaaattatagcagcttttaatggtgttatctttgaatggtaagattaggcatgacatttgttttcttctttatgtttttcaatgttttaaaataagaactttttgaaaaatgcttttttttaaacaaagagcatagttgacagagagcatctaaggttttcaataaataatcttaaataattcaatgaaaattaaattgcattacaggcagtattcagggagtagacaagagtgaagcagccccgacagggagttaacctcctaattgggaaaatagagcagagagattcatgctgctgaagaagcactgtgactatgcaccttcactcctccaactc

SEQ ID NO: 12854 - DNA, 1154 bp, Homo sapiens
  misc_feature (527)..(527): n is a, c, g, or t
atctgtaaagtccccaacattccccccaattccttttttctgcctggttctgccagggactttatcctcttcaatattggcaggttgtggatttttgtctgggagcaaaatgcattgaatattttaaactggaaagatattttaaattgactttaatggaaacatattttattgttgggacagataggtttgttttacttttgttttgttgccatgggaactcaaggaacactgtagtctgggtattccaatgatagcaatttgctggtaccacccttcccccagcttcattttctgatggagatggtgacaccacgagggaccctctttactgagaagaatgacagcattacctctgagtgtgggaaggaggaggagggaaagcagagaattgggtgggagagacaccccatggacgcccaaggacccctcactctgggttctgagagccctgggccaacctggctctctagatgggtgctaaggagactttaatttccttttctaattttgcaagttcacaaagnagggcaccattctcatttcggttcctttttttttttttttcattttttctttcattttttttttttttctccccttcactcaactcagcagctggctggctgacagcagtaaaaaatacatttcactttgctggtcaaaggcctaaagccagaagcaggaaatctggaattaaatgtttcttgtatctggaaagaggcatgactaaggtaaaactgaatccaaacacaagccctacttgttcaaggcttccagagagagtatatgagagtgtgtgagtgtgtgagagagtgtgtgtgtgtgtgtaaaggtcaaccgagtgttttttcccccccttctaaatcattgaaagataattatagtggcttggggaaaaaaagcctcctaaaataaaacaagcaaggcagaagctaaaaggaagcaagtagaaatatgaccagctaagctttgaagaacagggcacggtctcgcacggcacacaatcgctgcttcatatagtgatttccgtttggtgcaattttcactgaatgttttttcagttatcctgtcatggtacaacacaattaccccacaggatatgatcttatcatatgattattagaagtttttacagtacaagaggacaaaag

SEQ ID NO: 12855 - DNA, 240 bp, Homo sapiens
cctagtagaatgccagacaggcctacatacgcctgaatccttgggaatgcacagctaggctctgaaaatacctctgtatggtattgaatctacttctggggttgaaacgggccttaaagatacttgggtagttaaagaaaattatttgctcatctaatcaagtgatgtttgaatctgtctgctggtggagtgaggactgtggaggaaggatcgacaaatatttattgagtagatgctgaa

SEQ ID NO: 12856 - DNA, 712 bp, Homo sapiens
aaaacattacccactttgcatttcacttctgttcttttcctgtgagacagatactactatctatcctatttttatgggttaaaaagcacagatcaattgaaaaagaactggaaggataactgctaaactgagaactgttacatccaggcacgttgactcacgcctgtaatcccaacactttgggaagctgaggccggtggatcacgaggtcaggagatcgaaaccatcctggccaacatggtgaaaccccatctctactaaaaatacaaaaattagcgggtgtggtggcacacgcctgtaatctcagctattcaggaggctgaggcagaagaatcacttgaacctgggaggtggagattgcagtgagccaagattgcaccactgcactctagcctgggcaacagagtgagactccagagttgagactctgtctcaaaagaaaaaaagaaaaggtttctgttgggccaggcccagtggctcacacctgttatcccagcactttgggaggccaaggcaggcagatcccttgagtctaagagttttgagaccagcttaggcaacttagagagaccccgtctttacaaaaagttagccagacatggtggcacatgccatggaaggctcacttgagcccgtgaagtcgaggttgcagtgaactgtgatcttgccactgcactccagcctgggtgatggagtgagaccatgtctcaaa

SEQ ID NO: 12857 - DNA, 916 bp, Homo sapiens
aaaacattacccactttgcatttcacttctgttcttttcctgtgagacagatactactatctatcctatttttatgggttaaaaagcacagatcaattgaaaaagaactggaaggataactgctaaactgagaactgttacatccaggcacgttgactcacgcctgtaatcccaacactttgggaagctgaggccggtggatcacgaggtcaggagatcgaaaccatcctggccaacatggtgaaaccccatctctactaaaaatacaaaaattagctgggtgtggtggcgtgtgccttaatcccagctactcgggaggctgaggcacaagaatcgcttgaacctaagaggcggaggtttcagtgagctgagatcgcaccactgcactccagcctggcaccagagcaagactctgtctcaaaaaaaaaaaaaaagaattgtggtcacttccagaaaagaattaggggagtgagattggaagtggtaatcataggaacttttgtgtcatctatattttccttttttccaaggaaaatattcatatattaattgtttaattaaaaattaaattttggctgggcgcggtggctcacgcctgtaatccctgcactttgggaggccgaggtgggcggatcacgaggtcaggagatcaagaccatcctggctaacatggtgaaaccccgtctctactaaaaaatatgacaaaaattagccaaggcaggcagatcccttgagtctaagagttttgagaccagcttaggcaacttagagagaccccgtctttacaaaaagttagccagacatggtggcacatgccatggaaggctcacttgagcccgtgaagtcgaggttgcagtgaactgtgatcttgccactgcactccagcctgggtgatggagtgagaccatgtctcaaa

SEQ ID NO: 12858 - DNA, 412 bp, Homo sapiens
ctgcctggctgaagaagaggatctccttacaaaggccttataactcagacctttaccctctcatctgtctcttctgaaatactgcactctagcctgggcaacagagtgagactccagagttgagactctgtctcaaaagaaaaaaagaaaaggtttctgttgggccaggcccagtggctcacacctgttatcccagcactttgggaggccaaggcaggcagatcccttgagtctaagagttttgagaccagcttaggcaacttagagagaccccgtctttacaaaaagttagccagacatggtggcacatgccatggaaggctcacttgagcccgtgaagtcgaggttgcagtgaactgtgatcttgccactgcactccagcctgggtgatggagtgagaccatgtctcaaa

SEQ ID NO: 12859 - DNA, 446 bp, Homo sapiens
cggatggcctcgttcctgcccaccacagcaattactcctgaaactggtaccaccctgctctaatgtcccctggccagggtggggacaacctgactcattgtagcctgaagtccccgggtccccagagcccccgttgctgatacacagcaggatgattcacccccctgtggagctcctggagcctcccctcatgacagccagcttctgaggcccatgctaccggtatgtcaccacacgtgggggcacgtacaccccatatgagtttgcctgggttgacacgacaaactagcaaagaccgggggctcaaacaacagacttctatcgtctctcagtcacggagcctggaagtctgagatcagggtgtctgcagggtgggcttctcctgaggcctctctccttggcttgcagatggccgccttctccctgtgacctcgcgtggtcatccc

SEQ ID NO: 12860 - DNA, 416 bp, Homo sapiens
cacctgacagccagctgcagcctccagacatgagggtatctcaggccatccatgtgcagttgatccaccatatcattgcagttacataagtgaccctgacacagacagcagaaaaccacacagttgaccacaaaataaattgctaacccagagttatatattactaaaatgtagttgtttacaccgctacatttttgggatagcaatagaaaactgacaaaaacagctgcctaaactcaccttttgggccaaattagtaaaagggcgaaccacagaatttgtgcctacattgcacagagtggataccagaggtagatgagttaacctcaggaagcaaagacagtctcaaacatcaattatccaggggtgagcagagaaaacaagccaggcataaaaccaaacacgtaaattcactc

SEQ ID NO: 12861 - DNA, 596 bp, Homo sapiens
cttaatttttcttttttttttttttaaagggtgaagtttggggagaactcccaagagaatgggcacaggaagtagcatttatctacgcactaaaatgccagacacttttaaacacctcacatttacaacaattactagccccattttccagatcctaatactcgggttaagtgattcacccaaatgcctggatcttgaaaactgtagcccaaatttaaacaaggtatttccggattcagagttcttctgataacaggcccaagtgtaaggaaacaaagggcgatcagaccccagaaaggcctgtcacgaggagttttgagagtagtcagactgtccagccgcggagcaacctaaccaggcactggaagacaccaccagatgctcagggcaaaaccttttgtcccctctccgcagcgaggcaatccaggccggagagtcagatgcacctgagaaaaccaatatccccagggcatatcttggggttgggtcaaactccattccttatcctagaagccctgcttatgggtcccggaggttgactctgctagtgctccggcgccctctagcgattgtccattccaatgccagctctctct

SEQ ID NO: 12862 - DNA, 473 bp, Homo sapiens
ctgcatcatttcaatgacatttttagcaccagaaaaagattctccagagatgttttgagtattttggaaaaagtttaattctgggcctctttctctgtgatttgaagcactcacagaactcagttattcatgtaataacattgattgctaataacgttgattactaaatttaaatgctaaagcttgtcctaagacttaactttttttttttaaatgaaccacctatattagtaaaaaaaaaaaaaaattaagtatgtaccattcccagtgtatgcacatttttaaatttagaaattatatatgtgactactgcattaatattattatgttaaaaacatatattaaaatagaactttaaaaagatgagaggaaatttatactaggggtcagcaaacattttctttgaagggccagatagtgaacattttaggtttttcagcctgtatagtgtgtactggaactattccactgtt

SEQ ID NO: 12863 - DNA, 1515 bp, Homo sapiens
gtacgctttcttagaaatgtgagcaaagaggagtgccttaaatgtatgaaaacaactgaaattgaaataatatgatgcataagaactaataaagcattttcttattttttaaaaatttgtaggctgggtgcagtggctcatgcctgtagtcccagcactttgggaggctgaggtaggaggatcactgtagcccaggagaccagcctgagcaacatagtgggacaccatctctacaaagaattaaaaattagccaggcatgggtgacatgtgcttgtggtcctagctattcgggaggctaaggcatgaggattgcttgaactgcagtgagtgaggctgcattgagccatgttcatgccactgcattccagcctgggcaacagagcaagacccagtctcaatgtttttttaaaaattttattttatctgtatttgtattttattaattttttttctagactaggtactgataattatagttaactcttcttactaggtaacttgtttttaatactctaaatttcatactatattactcaaaattcagaatgtaagccaaagagagataaagtatattaataaatgttaggtttaaacttgtatgatacatttccaaataggtattatatatttttaaaatatataatgtccatcttttctgtattgatgcctatacaaccataaccccagaagtactctcatactgtgaaagtcattgctaaattaggtattcactttcttaaacacatttctgagaaaagggtgtctttttagggcagatgacttagaagttcttttacgtagccaaggcaaaagattgtctattgaaagcttggaagggctatatgtacatttggaggggaaaaaaaatttatcttacctccagcaagaagagatttctaaaatattgtgctgaaacacaatatacctaggattagacacttttagatagttaaatataagaaatgctaggcaagcataatttgtatatgtataatacaccctgaaaattttattctcaacttcacttctgtttagatctgagacactaaaaatatttcctttagcagaaaattcttcaatgattatagaaagaaaatttgctgtatagtcacaaatttaatatacaaaattaagaagtgccttaaaaaaattgtaacctgataatacttcgcattagtcctcatttcaaatatgtgaagcagccaagatccacaaaagtgtgtattttcatgtattgaatgaatatattaaaatgtttcttttaaattttattttagaaaagatacagtgaaaaccactgaaactgagttagatgaatttgagatttgactttgtttgctttaatatatactagatagatagatagatagatacatagacagatagatacatagacagacagacagatagatataaatctcagcactttaagaggctgagctgggaagatagcttaaagccaggagtttgaccagcttaccagcctggataagggaagactttgtctctacaaa

SEQ ID NO: 12864 - DNA, 468 bp, Homo sapiens
agaggtttaattggctcacagtactgcaggctatacaggaagcatgaggccagcatctgctcatggtgagggcctcgggaagcttacagtcatgcaaaaggcaaaggggaagcaggtgcatcacatagagcaggagaaagagagagaggtgggaggtaccatactcttttaaacaatcagatttcctgtgaagagaagaactcactcattgccatggaaaggacaccatgccatttatgagggagctgcccttgtaatccacacatttcccaccaggccccacttccaaaattggggatcacatttcaacatgaaatttggagggcacaaatatccaaaccatatcattccccttattttgaaatattgttcagaattccagttcagtaatatggtttcttattccctaagtcaactgccagcccttgaggtccattatgaaagaaaacttcaaagggaacgctccaa

SEQ ID NO: 12865 - DNA, 446 bp, Homo sapiens
atgcctgcagtttccacggggaaagctcaggttagtgaagggggcctaaaatgtaggtatcattggtgtcgaaataaatatacctttgaaaacgaccttttccaaccccattgaagttatctacctctcttatgaattaagtgtagaaacattgtgaggagcagggccaaggttaataagcaaagatttcggaccaagtttttatacctttttatcctgtttccccattgcaatcccctcagtgcatgtgtgtgcgcgcgcacacacacacacacacactctcactcatgcttctaacaaaaatatgttgttacagtacagattctcagtaaacatttcttaaataaaggcagccataatgtatgtttgttagcctatattagtgtgaggaaataaagtagggctactttataaccaaaatgaggaaaataaacagtaaaagaaaa

SEQ ID NO: 12866 - DNA, 792 bp, Homo sapiens
ccaagatgatgccactgcactgcagcctgggcaacagagtgaaaccctatcccttaaaataaaaaaaaagtagggaaggaatgaggaaaacacccaagggaagagcattttagttggagggaactgtatatgcagaagccctcaggaggcaggaatcatttcattcattactgtatcccaaatgcttggcacatagtgggttttcaataattaatgagtaaagatgaaacaaggcgtatgtgcgtgtgtatctgtgtgtgtaatgtgatctagtttgccttttaaaaagagagaatagagacaccacagatacagagtactcggtaaaggagatgttggaatggttgaagaaatgcttggttgactgttgcttgagtcattggttggttggctggttctttttttcttttttaattttttttttctcctggaccctcttatgggttaagactgattctttcattggctaatttgttgggttttggttaactggttcattggttgattaatgggttgattggttggttgactgatttatttggttggttgaccgattccctgattgattggtcgactagttcattggttggttggttggttggttggttgactgggtggttagatggttgattgttggttggttcgttgactggtttattggtttcttcactggtttgttggtttattgactggtttgatgattcagtggttagttgttttactgaatgaatgggacagatgcacctgaatgagacgtgagtcagcacccaactacgcagaagaccagcaact

SEQ ID NO: 12867 - DNA, 516 bp, Homo sapiens
aaaaaaaaaaaaaaaattaataataactataccttatcaaatgctgacaagatgacagacactgtacaataaatgttacacatactggttcatttaattttcacaataaccatgtaagatcagtattatcatctgcattttgtgaatagcatgccaaaatccagagtgattaactcatccaagatcacacagcagtagatccaagatcacacagtagtagaagagtattcagatccaggtttatctgaactccaaacttttgctccttccatgacaattttcaagttacatatctagcaaataaaaaaaaaactggatagcaatgatagagaaagtaaacttatcaaggatggcaggcaaacagacattgtattcctgcttcctggtagaggagcaaatgccattgactttccatgggcagagaaaagcaacgagcaaaggaaacacaagcacagcacacttgcccatcgtgtgccaagtcaaagagatgaaaatgcctcctcggatgggagcatg

SEQ ID NO: 12868 - DNA, 451 bp, Homo sapiens
gcatatttagtagagacgaggtttcacgaggttgtccaggctggtctcacaaactcctgacctcaagtgatctgcccatctcggcctcccaaagtgcagggattacagacaggagtcaccacgcccagcctgaccattctttttttaataaaaatattcttaccaagagtatatatttgagttagctgcttacaggtcattttgcttgcattacaacgataatcaaactttgacacacactcataatcaaattgtctgaaaactttttttttaacttgaaatattgaattacttttagatttacagaaaagtttcaaaaatagtacagggattttctggctgggcacggtggctcccacctgtaatctcagcactttgggaggccgaggctggcggatcacgaagtcaggagatggagaacatcctggctaacacagtgaaaccccgtctc

SEQ ID NO: 12869 - DNA, 285 bp, Homo sapiens
tacccaagaggtcatggcagaatcaacagcttgttttgttttctttaaaccgggaccaaaaataattcccctctggttggttcagtggcttattaactctggtacttggggcaagaagagtgagaggatcgcacgatcttctaaggcagccttgaatactgaggcccacacaacaatctcctgaaatggttccttgaagctaccagatagtctttctgccttgcagtggggtttctagtattggaaattctgggcaaatattaaaggatggtgtattatgcagtt

SEQ ID NO: 12870 - DNA, 323 bp, Homo sapiens
agttgtttcggtgatggagagggcattattggctttagtgggcagagaccaggacggccagaagtcctcctgcaataggcagaaaagtttcacaagaattgtcccatgccccacaggacttttatatatctaatatttgagtgttacatgttcctacttataaccacagcacgaccataacaattaggaaattgacactgattcgataataccatcgaatccacagaccccactttatgggtccagcatccagactagtatcacaggttggatttagttgtcacgtctcattcgcctccctcaatctagaacagttcctcaga

SEQ ID NO: 12871 - DNA, 395 bp, Homo sapiens
cctcctctctctcttgcttttcctgattttctctccccacgacagctggagggattttcttaacacttaaattggatcctgtctctgtcctacctaaaaacctattgtgactgtctattgctcttagacaaatcaaactccttctcatggtttaaaaggcagtacgtaaactagctcgtgtcagcctgactttccagtgtccttcctgccagtcccacctcattgcctagcaggtactcttgtctccctccatcgcctccacaggcctgctcccttgagctctttctgtccctccatgaggcttggaatctctcccctcctacctactcactgtcatctatgtcccaactcattgtctcctcctcagagacttcttgagcactgccgctcgtatc

SEQ ID NO: 12872 - DNA, 336 bp, Homo sapiens
agacaactagcttttcaaccaggtaatttaacatctgtattaaaaagattttatgccaggcaccgtggctcacaccggtaatcccagcacttttcgaggccgaggtgggcgggatcacttgaggtcaggttgagaccagcctggccaatatggtgaaaccctgtctctactaaaaatacaaaaactagctgagtgtggtggtgcacacctgcaatcctaggtacttgggagactgaggcaggagaatcacttgaacctgggatgtggaggttgcagtgagctgagatggcaccattgcgctccagcctgggcaacagagtgagactctatctcaaa

SEQ ID NO: 12873 - DNA, 492 bp, Homo sapiens
tttgtttctccactgactatgtaaattccaaggaggaagcatctaattgaactagtttgggtcacatgcttgcctctttgctagtgaaaggcaggattcctagttacagtccagtgagtaagaattaattccccaatggaattcaaattgtcattaggaaggagaaataaatgctggaagctaaaaagcaacaaatgtttaacacagccactatttattcattgtgtatggtttaccagtcactgtgattcatgtgcattatctcatttaatgcttataacagggctagtagttcagatcctgttataatcctcattttacaggtaagaaaactaaagctttgagaaaggttagatagcttgtgcaaggtcacaccactagaaagtggcagaatcagaacttcagagagaacactcataaaagccatacttctcttgacagagctgtgtattagcattgatgataatatttactgaatctgtccttcagggg

SEQ ID NO: 12874 - DNA, 492 bp, Homo sapiens
taaatgtttaacttgtctttgttatctataccaagatataactggctgaaaaatatttattatgcatggaaagcactctgtaaaccttgtgaagtgataaataagtgaaaggtataattgttagttgacattaatataaaaaaggattattcttcaataaaattggttgatttgaagggaaaaaatccttttagttgaactagtagaagttagtaataactattgactcttgttttgtttattaaggaaactagcattgttaatatatactgattaatatttaattattcacagttgtttaattatatatttgtggatttcttttctaaatgttttaggcatatgaaaatattatagtacaacacctgtaatttttaagtagatcaaatattttctgtaagattgctttaaatgctccttataaattcacattgcaaaagtaacttaatatggaattaacacttgtcagataataaaacagccaaacttgtg

SEQ ID NO: 12875 - DNA, 622 bp, Homo sapiens
acaatcttctttattgaccctattagattttactaccgatttaagaagaatgctgttttatactttgtatttattgccagggcttttctgagtcttctatccaaccaacatactttatatgtcttaacaattctaacaattattttgttacgagagtccaagagtgaaagtttcaccaataatctgggaaaatatgtctttttaaaattttttacagtttactgtgtacatatcatgggcctacgtgagataaaacagtaaacgccacctatgaagtcaaactgctttgactagcaactgcatatgaactgcatagttttagttttataagaattttagctttatcggaggtaactattccaaccataagtaatatgtcatatttgaaagtttaatagccattgccacatcagatatgtctttcttggagatagaatcagtatgctaaatctatttaaaaattttacaataatgttacaaatatcaagattcaaaatggagatgacagactttccttaatagaagcaacaaagtggcttcattcttttaactattgccttagatgggtgccataaattatgtgtcttctgcattgttaaaataaatttatgaatgtatttta

SEQ ID NO: 12876 - DNA, 2710 bp, Homo sapiens
ggcttgaatcccggcgcctcagaggactatgaggcgggcgccaactgcttgggccgcagggcgggaggcagcgcgggagtggggcgttgaggggccggcctagcttggggctctggccttgcgtcttccgaccgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatat

SEQ ID NO: 12877 - DNA, 3376 bp, Homo sapiens
ggcttgaatcccggcgcctcagaggactatgaggcgggcgccaactgcttgggccgcagggcgggaggcagcgcgggagtggggcgttgaggggccggcctagcttggggctctggccttgcgtcttccgaccgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacagaatcccattgaaatgactggagaaatattaaaataaaaataatagcagagttggaaaaccagaaatttgaacagtgaaatttctggaagataagaagcagatgatttaagtaccagttaattaaaggatggaacagctaagccattccactcatctttggagcatctgattctggagtttgccaccaggctaagaaagcagctatctgaagtgggagctctgacccaagaaatgctgggatcggagaataagggaattatccaaaatggctccgaagaggaactgaagttaagctgcccacatgatctctctaactatgatgacctgccacttccgtttataatcaccatataagtgcctgtaatcatttgtgttcattaaaagtgaaccagaattcccatttggatgaaaaaataacacttccaactttaatcttaggccctcatttataaatatggacaaccaagaatcatcaaatttgaagaaaaccagtaacataaaaggaggcatgaaattaaaattaacctgttcaagaagatagttactaggagaaacatgaaatttttaaattaatgaatcaaaatcttcagcaattcataaagatactgtgttcataaagaataggatgccatgaaaaaaatatttagagtttctggaaattaaaaatttgattatgaaactgaaacactcagaagatggactacacagcagaatggattcatttgaagcttaaattcatgaaatggaaggtattaattggtcttagacgtttcatcagcaacttaattacttagaaaaaatctttctcagagtaactaagcaaaatgaacaatgaacccattaacgtgtggttttgttttttgggttttttttttttgagtcaaggtctcactcatgtcacccaggctggggtgtagtgatgggatcacagcttattgtaaccatgaaccattgggcttaaattatcttcccacctcagcctcccaagtagctgcaatgtaccaccatgccgaagttttaaaaaattattgtagagttggg

SEQ ID NO: 12878 - DNA, 2480 bp, Homo sapiens
ctcatgagcccacactaggctaggtcgaggctggtgggaatcggccgaggatgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatat

SEQ ID NO: 12879 - DNA, 1878 bp, Homo sapiens
aggctagtacgaggccgggtggtgatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatat

SEQ ID NO: 12880 - DNA, 3194 bp, Homo sapiens
ctcatgagcccacactaggctaggtcgaggctggtgggaatcggccgaggatgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccaggtttctatttgtatgcagtcagcttacaatgaaggaacactaatgaagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacagaatcccattgaaatgactggagaaatattaaaataaaaataatagcagagttggaaaaccagaaatttgaacagtgaaatttctggaagataagaagcagatgatttaagtaccagttaattaaaggatggaacagctaagccattccactcatctttggagcatctgattctggagtttgccaccaggctaagaaagcagctatctgaagtgggagctctgacccaagaaatgctgggatcggagaataagggaattatccaaaatggctccgaagaggaactgaagttaagctgcccacatgatctctctaactatgatgacctgccacttccgtttataatcaccatataagtgcctgtaatcatttgtgttcattaaaagtgaaccagaattcccatttggatgaaaaaataacacttccaactttaatcttaggccctcatttataaatatggacaaccaagaatcatcaaatttgaagaaaaccagtaacataaaaggaggcatgaaattaaaattaacctgttcaagaagatagttactaggagaaacatgaaatttttaaattaatgaatcaaaatcttcagcaattcataaagatactgtgttcataaagaataggatgccatgaaaaaaatatttagagtttctggaaattaaaaatttgattatgaaactgaaacactcagaagatggactacacagcagaatggattcatttgaagcttaaattcatgaaatggaaggtattaattggtcttagacgtttcatcagcaacttaattacttagaaaaaatctttctcagagtaactaagcaaaatgaacaatgaacccattaacgtgtggttttgttttttgggttttttttttttgagtcaaggtctcactcatgtcacccaggctggggtgtagtgatgggatcacagcttattgtaaccatgaaccattgggcttaaattatcttcccacctcagcctcccaagtagctgcaatgtaccaccatgccgaagttttaaaaaattattgtagagttggg

SEQ ID NO: 12881 - DNA, 1819 bp, Homo sapiens
ggggattggaatgggaagggtggaagatcattctctgtgctctttaaattgaatagagtcgtaagaaacatttccctccctgaagtaaattctttaaaaattttctgggttctcccggtgccacagtataggcgtgtggatatgtcacacaatggaggccttgtggtttcatctgtgtagacaggaagtcatttctctgggtccacaaatcagctgttgcctccagcaaaacaaatttgaccaccatttctcacccgacacatggagctatcatagtcaagaatgtccttaagtttaaaagaaatgttcttgggggatacatattttatatgtatatatatatttccagattctaaagctaaaacaaagcaaccagtcctaaagcctctgctttctcagagcttttctttctcccttgtcaggatcaaacacattccctgtcattctgcatcatggtattagagcaagtgaattctgtcagagtatcagattttccttttcagttgtttttagagaccgtaatttctctgtaaaagatagcactactgagatgaaggagcacctgtgtgtccgtactgcccctcgcatagccaaaagtaggggcgtgcatctcattctaccgtctaggattttcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatat

SEQ ID NO: 12882 - DNA, 1239 bp, Homo sapiens
gttagactaaggagtagtgatagacatttatagagaatgacttaacacttcagaaagatcactttgattagatgtcctttagtatttggtattcggtttatattattatacaatcttgtcctctttttttaagccaaccaggttttcctgtgactgtgacagtagagagtccttcatcctctgaagttgaagaggttgatgattcttcagagagtgttcatgaagtgcctgagaaaactagtatagaacaagaagcattacagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatat

SEQ ID NO: 12883 - DNA, 124 bp, Homo sapiens
gagttttggggatcatattgggaattaattataatatttactttattacttaatactaggaaaaactggaggagtgcctaaagcagttaaaggaagaaagagtgataaggcttaaggttgataa

SEQ ID NO: 12884 - DNA, 937 bp, Homo sapiens
  misc_feature (39)..(39): n is a, c, g, or t
  misc_feature (45)..(45): n is a, c, g, or t
  misc_feature (62)..(62): n is a, c, g, or t
  misc_feature (89)..(89): n is a, c, g, or t
tgtaggaccccactatcgctaagaaaccctctaaatggntaatgngcaatgaatatcttttnttctgaaactcaaccatgaattacggnttcagcaatatgattattctagagtcataaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatat

SEQ ID NO: 12885 - DNA, 279 bp, Homo sapiens
gttagctttaggcctctcaggtggtactttctcttgcctcaaatagttcccatacatatatgtattaatttgcactctgctgaatagttaatagagatcttttatagatttttagagttctgtgcctgttcagccctcttgtctctggtgctctatccagaaaactctaactgctttattgtccctgaaatctcagctctgtttcctcaagtctggatggatgtccaccacgctcccccggactctccctccctatgccatcatatagaaatgctctct

SEQ ID NO: 12886 - DNA, 365 bp, Homo sapiens
catgcagatgaaggaaagaaagctttgtgcggcttgcttgtgtgaacgacaagcccaggggttttgttttcttgtgtttacgtaggaaaatcacagacagggacttcccaagagactgtttctcttagccactgtctgctcctaacagttacaagaactgttcttcctcccacagctgtggcagaagcctgcttctgcagggtctctgatggggaagaactgagctgtttaggattgaactgcccacctactgttaagtaatgttctgtctgtaacacaggatttccacttaggaaaatgtgctgtacatttggctgcagcatttactacgcatctgctttacaagcctgttctgcagctccaag

SEQ ID NO: 12887 - DNA, 562 bp, Homo sapiens
ctaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaa

SEQ ID NO: 12888 - DNA, 353 bp, Homo sapiens
gtttaacccccaggatacaagcaatatcctagtaaagcactagggtcatatgcaacctcccagctgaatccagaattacagatgcatgtaagaaaacttattttcttactaggaaagctaatactaactaacctaggattaattttttcaagctactgatataatttaaagagtgaatatatgattaaaattttacagaaatatagagaggaaaaagaacacggtagagtttgcccctttggacaaatggctgaataactatagtacagatacttcttacgatgtttaaagggtcacatgtcccattcatgcctcatggcctcattatacacctgcttctgatgaaactgtct

SEQ ID NO: 12889 - DNA, 584 bp, Homo sapiens
gcatgtactgtctgtgactgggttaagttaggagaaaattgttcaattctatcccacctttcatatctcgccatcactctttccaaactcagataatgcagtcactctataggaaagcccgttttagatttccacaattaaagatacattgttgggttccggaggctggagtcatgctgcccacatcttgtttgggaagcaaaagctcccagtgagctggtgtgcccatgtgtctttcatgggactgtcccctttagatccccacctgtcacagccatagcttcggggtcctgtcatcacatcccccgggaggggaggcagaaggaggctgagggccccaggatttctgcctggtcccttctcactgtgaggacgcccttggcacatctttctcaagtcacacaaactattgcagttacatacagaattgctgacaggagcaggagatgctgaggaaacagctggcaatgtgacaaaattcttttctgggacaacagtcaaatcatgtatttgtatttttttaagtttaccaatgaattgtacaacaatgtaataataaagttcatcctaatatgaagtgcaaa

SEQ ID NO: 12890 - DNA, 369 bp, Homo sapiens
tgctgtctttttgtgcctcccgctaacacacagctgtttttgttcatacatcattttgtgttcaactgcctggttacttcctcaggtcccttttatggtgaataatggacacatgggagtttgaacacccaagtgtgtggttattcaaacaggaagtctcaaggaagcacagtaactttgtcagaggaacaaaagatgggacaggaaaggctattgatgattctaggcttcaaacatctgctgggaaatctgacaatttctgaaatacagatattccatagcttacaaacaagttggtttgtttatttggaacttgttccattttttaaaaatcagggtattaaatcttcgtaaaatagaagtggagga

SEQ ID NO: 12891 - DNA, 271 bp, Homo sapiens
taaaataaagatcagttcaataaataatagttacttttgtttgaagactgtggttatttattaaatgtaagcactatagtggatccagtaagaatgaagagatcaaaacaattattaatagggtttgataggaaaaattcaatccattaatttgtcaaaatagagtgttactgaaaaaatatatacatgtaaatagtcttagaaaagctttcttcagtcatgattgtgacacttaactccagcttagacaacgagagtgagaccctgtctc

SEQ ID NO: 12892 - DNA, 605 bp, Homo sapiens
ccaccttccaggtagaggattccacccatttgcttaagacccctcaagtctgccttcatcattttgggtatcatgggtctttactatcatttgtttagcttttccacattttgtgatatcttttcagcttttacctattagaattatttttccaagtctacttttggatagaatataattttactgtttttggttgttctctaagtgacattgaaaggtacacactttttatttttattttttactctctccaggatcttagtaggaaggaatgcattttatctttcaccacactgtgtaatctccttggcatcctctcctttatttgttggatttttcttttaattaaaaagtcattccaggtatgttttattgcttatttattctttccttatttactttctcaaaaactaattgaacataggaaagtaaatctttaattctgctaaaaatatcaagactattattgaaatctattcttacacattctttaaaatgagcaccccaaatcattgttctttcttgggacaaatgcaatgaagatagtgtgttagctatgcgatatcatcagtggtgtgcaaatgaggaaaaaaataaaaaaaaaa

SEQ ID NO: 12893 - DNA, 311 bp, Homo sapiens
gccaaggagaaatatagccccagggatatagatgggaaatgaaatcacctggcccctgactcagtccatctcccaggctaactgggagctactggatacaggcatcaggaaggtgatgtgaaagatgccgcaggtgaaagagaagaagaacgcggagcacctgagcagctgtggagcctcggattcgttggaaggcacattcttggaagaatagctcctgtaatgagattgggcacatccaggccatcttctattttactgtccgcataacacaatccaggaagtgaaatctcagcatgttcacagatcct

SEQ ID NO: 12894 - DNA, 895 bp, Homo sapiens
aggaatccaaggatgaggaaatgcctgagaactgaggaagttcagattctttttgtacatttaagatgaagtattcatttttaccacataccatgtcttctgtcatatttctgttttcatataacattgcaatagaataatgaaagatagtgacctctctagtctttttaaaatataagattctgcttctgtgtcaaaaaacaacaaaaaatggatattaggaacgttttgttgtttaaaaaaattactttgtttttacactttggtagaaaaaacttaaggaatatttcaaacataatacaaagtgagcagaatagaatagtgagcttttatgtaaccattctttttttttttttttttctgtaaaaagagacaaggtcttgctctgtcacccaggctggagtgaagtggtgctatcataacttgctgctgcctcagactcctgggcggaagtgatcctcctgccttagcctgccgagtagttaggactacaggtgcacaccaccacacctggctaatttttaaattttttaattttttttgtggagacgggatcttactgtgttgcccaggctggtcatgaacttttggcctcaagcagtcctcctgctgtggcctcctaaagtgttgggattgagccactgtgcccagcccattgtttttattattttttaaaggtttatttttaggtgaagtttacatatattgaaatgcacaaatcttaactgtacagttgttaataagttttattgagatataatttatatactatagttatatgtacataattcacatgcattctttgaaggtgtacagttcagtgattttttttagtatactcacaaagttgtgcagccatcaccatacctaatttcagaatattttcatcatccca

SEQ ID NO: 12895 - DNA, 344 bp, Homo sapiens
agaaaaggggcagctctgcactattccttcactcacatatttccttcctttctcttttttcatcatcttccctttctccctttatttagtggatttttaaaataaataaaatgctgtgtggcatagcactttgccaaacaggaaactctcataattttgtaatattttctagaatagattttagaccagccatagtgaaatttaattatggtgctaatgtgcttctgaagattcctgataaaagacttgtgcccttaatcccatcgactcaagaggccgaggtgggaggatcacctgagtcctggagtttgtggctgcagtgaactatgtactccagcctgggc

SEQ ID NO: 12896 - DNA, 375 bp, Homo sapiens
tgatcttggcctttaggtctttgggcaaatggaactataattccattgttcagtaaaattgaatgagaaagtgcatataaaatatgtagcatgatggctggtagtgtggatgcccctttacagtaggggtgtacctggctgcataccactttctgaggctctgaagagttccttgccttctttcttgccattcctgcccttatttgaggaaaaggatccagggaagacagaggctctggtagagattcttttggctgccagatttttgccctgagcaaaatgtgttaggtctccacaggttgaaatgccaccagattttaagaactctataatatgaaaagtcttttatttagcatttagtagctgtgaaaattt

SEQ ID NO: 12897 - DNA, 897 bp, Homo sapiens
caccaaactctggtgtagtccagggcagtggggcaggtaaattggcttccctggaaaatatgtccatctatgtgccttattcccagttcgtgcttttaagggatggagcacaccagccatgaactaaggctggagtagcaaaacatgaaatctgctttctacaaattatccagataatctcttccaatccccttctggaggaaaaacagagctgtatgagggtgacagtctggcaggtattcaaagctgcagtgaccatggcttggctcctgttgtatccacagagctgtttgattgggttaatttatacagtttttcctgtatgaatccttttgataagtatctttagaagcttctaattcattttaaaggaatgtttctctttggcttcatgtctcattcttttcacattatatattctggtgataaatgatggatccataaatacattacctttgctcagtcagtgttttctgttgttgatgtaaagtacacaaattggatttgtttcaggatagctgaatttggaatatgacattttgccaagtcagcatcacacttgcccatacaacacagatgtggattttgcagttgttttgtttttaaaattgtatatgtctgtggtgctattgattaatgtaatattgcattaatgtgctattacaacactctagggcattcatgaggtctttcagccagcagcaaagaattccccaaacaaaagcttttaataaaatacagattgcagggcaaagaaaagtatcaaccgtgagaatttatggatagcagaagtgcttgaggaatcaacttttgatggccttgccaatggaaataccgtgtaattgttatattatttcatttccctccaaatcattaaagatcatctatatatctatt

SEQ ID NO: 12898 - DNA, 411 bp, Homo sapiens
aatacagtgtatttaaatgctttgttagtggaagtagaaagtggtatcaggagtatataactagggcatataatctggatttggggaaggcctctggaagaagttaacatttgagacctaaaagatagtaagagttagctagatgaaataagaggggaattctttccaagataagacatttagtgtcctttagatacacattattgttggaagaaaattgtcaacaagatatataattggcctgatttgattgaatagttttaaggatttttcataacacaatttagaaagcatgcattatctgaaaatacaatatgtctagcataaacatgagaaactttaaagttctgagttatatagttattttatcttgttatctgtttacacaataaaaaagagactagttttgct

SEQ ID NO: 12899 - DNA, 1301 bp, Homo sapiens
cccagctaatttttgttctttttttttttggtatagacagggttttgccatgttgcccaggctggtcttgaactcttgggctcaagtaatctgctcacctcagcctgccagtttatcctttctggcatttgttggtcttgcacatattgattaatatttttgatcagatttgggatttgggagccattattcattcacatattttttctgccccttttctctcctctcattatgtttgttatatttactaagagtaattctttttcattattttataataagagaacttatgatagcattggctgaatttcctaagtaatgttcttgttttgttgtttgctaaatatgcttgattataacttatatttattcttttactcaatagttatttagtgtgatgcttcatgttgaggatttctggctttctttttcctcaaaaaaatcatgtttttatttcattgtaatgagacaatgtgggtgctgtcatttcctacatgcttagtttttaataacaaccttatgttgcaggacacatccctcattcttcttttttccaaaattttatctcattatcatgtagttattttatgtgaactatagaaacagcttgtcgagtgttcacaaatatcactggaatttaaattggaatggccctgaatttgtagattaattttgggagagctgtcatttttacaatcttcccatacattaatgtaatatttttctccttttattcgggtcttcggtatctgcgtatgtatattctacttattacttttaatctcccccattttctggaaaaaaaagatgtctttggaagtgcaattctggtgggaaaagtgtagatgtcatctgcatagactagagccaatcagtagggaatgtcattcaaaatgtgttttgtgtttgatcttaccatttctttcaaatgttcctagcagcctgcattatttataatgttctgtattcctggtttaggtaagtccagaggtgagagctggtattaggaaaatgacatagtaaggcatttgttttcagtaatggcagcatccgtttgacctcctttcccatttggaagggctttctccatcctgaaagctcctgtagacttggtgctcttttttttttttaggattcataccagttgaagactttcaaagccttcagtgtaactggttatgttcttactagaaaagtatttagggccaggcgcagtggctcatgcctgcaatcccagcaccttgggaggccgaggcaagtggatcacttgaggtcaggagttcgagatcagcctggctaac

SEQ ID NO: 12900 - DNA, 608 bp, Homo sapiens
ttgcccaggctagtctcaaactcctggcctcgagcaatcctcctgcctcctcagcctgttacagctttttttttaaggtaatctggtaacagctcttaaaagtagtgtgactgatgagtgcacaagcccgtccagccccagccgccccctggcaccttttctgagggtgtctactgccccgctgtgctgtgcccgctaatctgggtgtggcccgatcgcacaatggcttttctggaaggatccgatgctcacgaggcttattgctaaggaggaagatgcaacaggtccagctgttccaagtgactgggtcacgcttcacatcgatgtgcaatgtctcctgccacctgcctggatgcactctcgtgactacctggcaggctgggaacagcacgggggaggcccccgcctgccccagcgacctgcctgccctgctctcaagtgcagacccccaggtctgcacttccacgctcactacacaaccccaagtggccccccgggtggccccgtggccggatgtgcacccagcagagcagccacccttgagacctggggtgtggtctgggggctgtgtggagacctcccgccagggtgcaggagtgtctaagggc

SEQ ID NO: 12901 - DNA, 466 bp, Homo sapiens
ggcttgcagatggctgccttcttgctgtgtcctcacgtgaccttttctctgtgctcacacactactggtgtctcatcctctccttacaaggacaccagtcccatcggattagggccccatccagatgacctcatttaactttagctacctccttaaaggttctgcctccaagtgcagctacattgggggttagggcttcaacatatggaactggggagtgggggtacagttcattccataacaatagccaaaagaattgacaacaaggactcaaaacctacttgtacgccagtgttcgtagcatcattattcacggtagccaaaaggtgtaaccaacccaagtgtctatcaacagatgaatggttaaacaaaatgtggtatgtacatacggtggaatattatccagtcataaaaaggaatacagtactgatacaatgtggatgaaccttgaaaacatgctatgtga

SEQ ID NO: 12902 - DNA, 463 bp, Homo sapiens
tggttttcatttggaatctgatggcaaaccttcagggaaacagggtagctctaacggatttagagacactggataccacgagaaaactgttcttttacaataccacaacttaagtcataaccactgtcattccttaactgaaaaataaaaaaccctgtatttatgatgtatggattggtcatttcaattcatacaaacttttaatccgcaaaactgaggacctgcaatttaagtataacaccgttccgtgagatatttctctgaattatctttcatgatcaagcataaatttttgtttaaaacactttttacttaagtagattacagtttctcattataatcagtcattttatttggaattatagcaatccgggtttttttgctgtactaagacgtagggagtctcactttaggattttatttgcttcttagacatcatttatataatattccttgattttta

SEQ ID NO: 12903 - DNA, 447 bp, Homo sapiens
tcataccttacctcagtttcccctttaaaacagggttgctaattcctacctcacagggtggtcctcatgaggataacatgagataatgtctggggaaattgcttgggaaagtgtaaaaggccactcacacagaaacccctcatgacccatgtggccaaagtggggacgtggacttagaggccctggacccaggcctgggccctgccttgcctgtctggggaaatggtcctggcctttactcaacactgaccctgccttgggaggaagagcctgcccaggccaatctcccacgccctgaccgaagcaggtgccgtcagacagagtcctggcttgggagtcagagggactgagctcaacacgtgggtaccctagaacctgcgcctggataactgagttgctgatgcagcctgaaggggtgggttgcccctccacacctgtgggtgtttc

SEQ ID NO: 12904 - DNA, 372 bp, Homo sapiens
gtagagactgggtttcatcatgttgcccaggctggtctcgaactcaagagttcaagtgatccacctgcctgggcctcccacagtgctgggattataggcgtgagccaccacacccagctaatttatgttcttcataaatgatccagtgaacaaagcataccatactctaaaaaaaagaaataataataatctatttattgtcaggattatggtattcaatgattttcttctttccttagttttttaaaaaaaatgaatcaagggattattttaaggtattttatgtaaatggtgagagtagtcttttaaataatctttatatgaataacctttataatctagtagtatgaataacttttgaaagtcctccaa

SEQ ID NO: 12905 - DNA, 642 bp, Homo sapiens
tgagattcttgatgagtatttaatgaggaatcccgttatttaagatgtgtgcatatggtgagactttattattaataataacttttatattgtacgatcagatttgtataaaatatcctgcttgttttgagtttctgtaagtgccacaaccaaacatcatcaggtgcccgaaaatatattaaggaggctgaagggagatttcgtagtgttgaggaagaaaggttgggttgagaatcacaacatgtaagttttaatcttggatgccatttgggctgttgtagaccactgaatgtctggttatgccttcctttaaaatttttcaggctaaaattttatgaatcagaattttgggggcttggtagtgattcccctggtctccaggtggaggtggaatagccttctttgcatttaggcgtccatcattactagatccttccactctaagaagaggatgtcagctattctcgtagcctgtgagggcccatgagtctgtatttgatgagcacaggatacttgcattccaggaatcttccaggggctatattgtcctattctttccattaaaaaaaaattattaaaagtttggctataagaaatagtgttacctgagaatgaattaagagatacctatttcttaaatta

SEQ ID NO: 12906 - DNA, 484 bp, Homo sapiens
gcaacatgacaaaacaccgtctccactaaaaatacagaaattagccaggtgtggtggcatgcacctgtaatcccagctactccaagaattgtttgaacccaggaggtggaggttacagtgagctgaaatcacgccactgcactcagcctgggcgacacagtgagagagactctgtctcacaaaagaaagaacagaatgtatcctctgtggttaaggggggactactatatttgtaaactatgggtctgaaaagtggttaatactcaaaatatgtaaggaactcagacaactctagcaagaaaacaacttgattaaaaaaatgggctgaggacctgagcataaatttctggaaagaagacatgtaattggccaacatgtatatgaaaaaatgctcaacatctctgatcatcagggaaatgcaaattaaagccccgatgagataccactttacacctgttataggactgttactaaaaaaaggaaa

SEQ ID NO: 12907 - DNA, 1008 bp, Homo sapiens
ggtctgtccacacaaagaggggcaagcctgcatgagtaaaagggagagtgggggcagatacctgccttcattgtccagagggtggattttatttaattttagtttaatttattttttgagaaagagtctgggtgatagagtgagaacctatctcaaaaaaaaaaaaaaatgatgccacatgacttggggcaggttgcttaatctctgtgtgctttggtttcataagactaaacataggaaattgagtactcaaggagaggatacaagtaaagcagtaagcctggtacttactaagtgttctccgaaaaatggtatctgttatattatcgttattatctttgcctagaagctaacaggtacttacttgagcatcagtggaagccttgtttgcctccttgcagggtgcattttgccagagtccaccaagcccttttgtttagggccaaaccttttgactccccagtacccccaagggggcacaagctgaagtggaaaatctgacctgacctgatctgatctgggttttaaaattttaattttgtatttcaacataagttcagacttagagaaaagttgcaagaatagtcataggagctcagtcccttggaactcaggggtcagggcctgagttcacaggggctcttcacctttatcccaattaccctaacataacattttaccacatttgttttctcttttctcatacatgtatacagtgtgtatgtgtgtgtatatgtgtgtgtgtgtgtacacatgtatacatatacacacacattcacacatttcaagggaaaaaagattaaaaatatgtgtttatgtatgtacacacatgtatacgtgtgttggagaatgctgtagtgaatagccctgcctcaggtttgcttctatggccctaccagctttgtacccatcattatccacctggctttttacctctgagtacttcagtatctcctaaaatcaaagactctttcttacattatcacaccccatcctaaaatcaggaaa

SEQ ID NO: 12908 - DNA, 455 bp, Homo sapiens
gccagggtggtctcgaattcctgacctcaggtgattgacctgccttggcctcccaaagtgctgggattacaggtattgagccacagcgcctgacccagagggtggattttagagctaggcctctggaatcaaatcgtcatgccaggccaggagtggtggctcacgcccgtaatcctagcactcagttgcgaggccaaggtgggtggatcgcttgagcccaggaatttgagactagcttgggaaacatggcaaaaccccatctctactaaaattacaaaaattagccgagcatgatggcaggcgcctgtagttctagctactcaggaggctgaggtgggaggatcacctgagcccaggaggttgaggttgtggtgagccatgatcatgatcatgccactatactccagcctgggtgatagagtgagaacctatctcaaaaaaaaaaaaaaatgatg

SEQ ID NO: 12909 - DNA, 994 bp, Homo sapiens
atcaagaacaagacaatgttttgtgcacattaatttttgcacagactactttaaaagtttaatgcatgccattctattttccattatttatttacaaggagaaaccacacatatgttaaagtttgggagtgtattttaggaaatgattccttttctcatttttggctttagatattcttttttctttaaataagggtggaatataatgctgacaacatcaggcccttgtaatgcctcctctattcctctgcacagactgtgtccccacattggcttcctgcctgccagcctctgtgcctttccttgtgctgtccccagcctgggggctgggaatgtccttatccatttcttttgtgcctgttgaagttctgcttgtcccaccaggctcagatcagatacctcgaaggagccttttataatttcctcttcttcctcctcccctctcctccagttagaatggatttaccttccacttgtttccaaggcactttactcctggtgcgtgtatttcatcctcttgcttgtatacctctctctcctggttactgtaaactctgaagggcagcacttaaggaattctctctgccttaccttgtctagtatgatgctttctgttacagatacctggaaaatgggcgttgaattaaattatttactgaattggcaaaaaaaaaaaaaaaacggaagcggccgcaagcttaatcccctttagggggggttactttcacctaggccctggctcgcgcttatacaaagtttgccactgggataacctcggttaaccccaatttaatcactcttgcgacaaattcctcttatggtccgcgtggtctccaacgtaatagccgcccccccctctagcctattctcacaattttatcggacataaatgtcaacagagtactctcccctgaatgttacgcataacctcctggcaattcttgctcgctatgtcttcttccatcatgtactcttctcccggctgttcgcatcc

SEQ ID NO: 12910 - DNA, 573 bp, Homo sapiens
gctgctgtcttctacacatagacacgcacacacaccctttctcgcacacacacacacacacacacacattctcacacattctcacatgctagacccttctaagcagcttgtccgtttttacacatgtatctgaactctcctgcatcactcttggccattttctcgcattcgattgcttttgccgttttttatttagatcagtacttgatttcattttcattttccagtctactttggggttctcgcagtggataatttagccaaaatgtttttcttgtggagacattagctgacaattcccaccacagactggcttgtacgtcctcccagggagacctaaacctggctcccctcccaccgcagttcttaatattgtggataagagatccatctttctcattctggatacctacttagtgctcatggaagaaggggtgccctgcccagccccagctgctaagctcacacctcctgtcaaaaagtcccaggacatgcacgacgagaggagcaagctggtgaatgagtatgcgtgtcgagtgctggaacttctggggatggggcatcgtctgtttg

SEQ ID NO: 12911 - DNA, 597 bp, Homo sapiens
gctgctgtcttctacacatagacacgcacacacaccctttctcgcgcacacacacacacacacacacacacacacacacacacacacacacattctcacacattctcacatgctagacccttctaagcagcttgtccgtttttacacatgtatctgaactctcctgcatcactcttggccattttctcgcattcgattgcttttgccgttttttatttagatcagtacttgatttcattttcattttccagtctactttggggttctcgcagtggataatttagccaaaatgtttttcttgtggagacattagctgacaattcccaccacagactggcttgtacgtcctcccagggagacctaaacctggctcccctcccaccgcagttcttaatattgtggataagagatccatctttctcattctggatacctacttagtgctcatggaagaaggggtgccctgcccagccccagctgctaagctcacacctcctgtcaaaaagtcccaggacatgcacgacgagaggagcaagctggtgaatgagtatgcgtgtcgagtgctggaacttctggggatggggcatcgtctgtttg

SEQ ID NO: 12912 - DNA, 555 bp, Homo sapiens
aaccttatatcaacacctcaacaaccttttttataaaaatcttataatttggttctaaaatgatatacagaaatgccccaaggcaagagtagctaagacacttttgaagaacaaatttggataacttattagacttcttataaaacagtggtaattaaggcaatgtggtgttacacgagtaatcatgtagatcaatggtaaaagagaatctgaaaactgataattacctgtagacacttgaattatgacaaagttggcattctagaacaatgggaggaaactcaccttttcagtaatgcctctggctcagttatccaaatgggtaaaacaaagaaaaaacaaatttactgcataccattcacaaaatttactctgcctaaacctataatagaggacaatgtatagcagtaagtatagatcaggcaaaaagaaagcctgaaaatacctaagcaacagtctcaataggttagaataaaaaaacgctgtgatctaactccaaaaaaataaaaaggacatgataaaaataaaagaagatgaagaaataggaaaacacac

SEQ ID NO: 12913 - DNA, 433 bp, Homo sapiens
cgccgttccacattgctggggctcggcggtggtgagtctgggagctgcacagcattatggcgggtgcagtggttcagttgttattagtgagtgtcattgtgccctgtttgcaagcactcaagtgttcagaggaggaatcaagggtaccaaatggagaaaaacaatacacaagagtctaatatctttaagtgggtaaattatcttttccttgagaaagcagaaaatgttaatggctaagtctacaaagacattttataatagaagtaaataaagaaacaaaagattgttccagtactattgtgtgcaattaaagcctgtcattcagtaccctaaattaatctaagtactctgacgtaaatgtgtatgtcataaaaggtacattttgtcttgaattttttctttatataaataattaacaactggaaaaaaaaaa

SEQ ID NO: 12914 - DNA, 1630 bp, Homo sapiens
catagtaaaatgaagtaaaatggaaagtttggagtaggagaaaagagagattagatcttaaggcacttgatggcctccaaaaatcctgactttggaacatcaaatgcatatgtgcacttttatctttgttctgagtcactgcagtccccaaagtcatatgccaatgttcacactgaaatactgtattgtacaccaaactggaaggcaattttcctatgaaaatcaaagccggtatattcattggtatgctctatacagatatcttaataaaaattttatagtgtgaacagtgcacagagttaaggcataaaaatgtatcattctttataaaaatctactgaaaatgtgtaatcattgaagacagttcttttaagcatgattttaaaatagcaactgaaattcaatcattttaaacaaatgatggtagtaatccattagttatggccagcagtgttctttggagagccacaataatttcaagaggaaaatataccagtgaaaattgtgtggctattttgagtagaattggtcagttgattattttgtgtaattgagatatatgtagtagtttaagcatgattcttgaagaaagcaatagtgacttttgcatagggagattttggtagaaacttcttgggactaaacaagtttagagatgcatttaagaattattcacaaaatgtgtaattctaaattaaaacataaatatattttcaaaagcatttgatttctctgaagcatgatatagctggtcttacctagtgaatcaggattgtcctcaggtaaatgaaatcatgatacattattgcagtgaactcaagtgcaatactttgtaagacatataattcctatgattttcacatttttatatcttatatatgggaaaagccaaattaaattgaattcagattaattccagcattagactaaatgagcaaacttaagtaaatgtacaaactaggtaagtataaaaccacaggttaacaatattggagtacttttagaattacattaaaactgtcttaaatgtcctatcccaaatctaaaaaaaaagaaaatggcaggctgagataatacagaattttaaaatgcactttgtaccagtgtctatatggaaagaagtagatgctgaatacctcaagatgccaagggaacaagcaacattgggaagttgtcacaacatgctcaaagacaaactacaattgtctgctagctatttcttcagaactggaactaatacgactatccttttctgttttatactttgattagaatgttatttcctcgcttacttaaaatgtacttcaactttttaacaactgatacaataacttcataaaagtataacactaggttgaaaccttaaggaaaaattgaaattgttaatgctttcgatcttttgggaggccagtacacagacaaataaatttcttctttttatgatacaaaatgactttgtattcaatcagaagcatatacttatgttattttgggtttgtttataattctctcattgtaaccaaattattttaaaatgtatagtataaaaagttacccgtggtattaagtgacaaaagcgtacttttattacaactccagttgttagattgcttctcagaatgctaactgt

SEQ ID NO: 12915 - DNA, 2938 bp, Homo sapiens
ggcataaccacccaacaggctccttactcaagctcgggttcttctcctaggcggaagccagaccagagagcgtgcgtgtttttcccagggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcagagagtggatctttcctacaattgctgctggaagggaactatgaagccatattcttaaattcaatgactcaaaatatttttaattcaacaacaaccgctgaagaaaagattgatagctacctggagaagcaggtagtaacattcctggattactcaacagatttggacacaacggaaagacaacagttgatatttctacttggtgtgagcagtttgcaactttttgttcagagcaactggacggggccccctgttgacttacaccctcaggactttttgtcatctgttttgttccagcaattcagtgaggttaaaggactggatgcatttgttctgagcctgctcactctagatggtgaatcaatctacagcctgacctcgaagcctatactactgttattagcacgcattatcctagtgaatgtaagacataaactgacagctattcagagcttgccatggtggactttgagatgtgtgaatattcatcagcatttgcttgaggaacgctcacctctgctttttactcttgccgaaaactgtattgatcaagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtgctttgggaaaaagaacacggttccaggaaaattatgtggcacaactgattctagatgtaagaagggaaggggatgtcctttcaaattgtgaattcactccagcacccactcctcaggaacatttaaccaagaatcttgagctcaatgatgacaccattctgaatgacataaagttagcagattgtgaacagttccagatgccggatctgtgtgctgaagagatcgctattattcttggaatctgcactaattttcaaaagaataacccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggctcttgcagaccaatttgaagataaaactacatctgtattggaacgcctgaagattttctattgctgtcaagtaccacctcactgggccattcagcgccaacttgcaagtttgctctttgagttgggatgtaccagttcagcccttcagatatttgaaaagctagaaatgtgggaagatgttgtcatttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcagctcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaaaaaaaaaaaa

SEQ ID NO: 12916 - DNA, 1021 bp, Homo sapiens
agaattgagctgtacagatctggcatgtcacttccttgggcttgtgtcatcagcagttgtgaagtccccattggggacttggtagcatggaaagccacacaaagatgtgctgcatctgtttttgtctgtgtgggtactttgttttcaataatattttgtctccttgcctaattttatttgtctatgcacatgtgtgcgtgtgtgtgctcgaatgcatgcgtgtatatgtgtttagggtctcttcccagtgatccgtaactcaccaaaaatcacctgtttttcccaaaattccctggagcagtaaattaccattcttaaagaaggatagagaaaggccaggtgcaatggctgacacctgtaatctcagtgctttgggaggctgcagcaggagactagcttgaggccagtagttcaaggctgtatgccacacctccagactgagcgacagggtgagaccctgtatcttaaaaaaaaaaagaagaagaagaagaagaaggataaagggaaaagctatgtacataattattattctttttcaacaataaaaactttccaggtagaagtgtttctaaagtatgttactataaaaattctaattaaataattggcttttgtacctgtgaattattattaacactttttaatggatgtttctctccatacttatcttccagtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaaaaaaaaaaaa

SEQ ID NO: 12917 - DNA, 2628 bp, Homo sapiens
ggcataaccacccaacaggctccttactcaagctcgggttcttctcctaggcggaagccagaccagagagcgtgcgtgtttttcccagggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcagagagtggatctttcctacaattgctgctggaagggaactatgaagccatattcttaaattcaatgactcaaaatatttttaattcaacaacaaccgctgaagaaaagattgatagctacctggagaagcaggtagtaacattcctggattactcaacagatttggacacaacggaaagacaacagttgatatttctacttggtgtgagcagtttgcaactttttgttcagagcaactggacggggccccctgttgacttacaccctcaggactttttgtcatctgttttgttccagcaattcagtgaggttaaaggactggatgcatttgttctgagcctgctcactctagatggtgaatcaatctacagcctgacctcgaagcctatactactgttattagcacgcattatcctagtgaatgtaagacataaactgacagctattcagagcttgccatggtggactttgagatgtgtgaatattcatcagcatttgcttgaggaacgctcacctctgctttttactcttgccgaaaactgtattgatcaagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtgctttgggaaaaagaacacggttccaggaaaattatgtggcacaactgattctagatgtaagaagggaaggggatgtcctttcaaattgtgaattcactccagcacccactcctcaggaacatttaaccaagaatcttgagctcaatgatgacaccattctgaatgacataaagttagcagattgtgaacagttccagatgccggatctgtgtgctgaagagatcgctattattcttggaatctgcactaattttcaaaagaataacccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggctcttgcagaccaatttgaagataaaactacatctgtattggaacgcctgaagattttctattgctgtcaagtaccacctcactgggccattcagcgccaacttgcaagtttgctctttgagttgggatgtaccagttcagcccttcagatatttgaaaagctagaaatgtgggaagatgttgtcatttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcagctcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcagtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaaaaaaaaaaaa

SEQ ID NO: 12918 - DNA, 1712 bp, Homo sapiens
caatgatgcatacaaatactgaatggcatcgcgttcccagatgtaaactgacctggatgtcgcatctgtgtactgaatacagcgctataatacttggagtctgctctacattcaaaagaataggcgagtgcagagattaacttggaagtgtcgctactggcgatctaacagtcatgtacggtttcatataacaaggtgcctgaggcattcagacatcagccttgatcctccggacaaaacttgagaaaggaagtactcgccgagtggaacgggcaatgaggcagacacaggctcttgcagaccaatttgaagataaaactacatctgtattggaacgcctgaagattttctattgctgtcaagtaccacctcactgggccattcagcgccaacttgcaagtttgctctttgagttgggatgtaccagttcagcccttcagatatttgaaaagctagaaatgtgggaagatgttgtcatttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcagctcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaaaaaaaaaaaa

SEQ ID NO: 12919 - DNA, 1655 bp, Homo sapiens
ggcataaccacccaacaggctccttactcaagctcgggttcttctcctaggcggaagccagaccagagagcgtgcgtgtttttcccagggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcagagagtggatctttcctacaattgctgctggaagggaactatgaagccatattcttaaattcaatgactcaaaatatttttaattcaacaacaaccgctgaagaaaagattgatagctacctggagaagcaggtagtaacattcctggattactcaacagatttggacacaacggaaagacaacagttgatatttctacttggtgtgagcagtttgcaactttttgttcagagcaactggacggggccccctgttgacttacaccctcaggactttttgtcatctgttttgttccagcaattcagtgaggttaaaggactggatgcatttgttctgagcctgctcactctagatggtgaatcaatctacagcctgacctcgaagcctatactactgttattagcacgcattatcctagtgaatgtaagacataaactgacagctattcagagcttgccatggtggactttgagatgtgtgaatattcatcagcatttgcttgaggaacgctcacctctgctttttactcttgccgaaaactgtattgatcaagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtgctttgggaaaaagaacacggttccaggaaaattatgtggcacaactgattctagatgtaagaagggaaggggatgtcctttcaaattgtgaattcactccagcacccactcctcaggaacatttaaccaagaatcttgagctcaatgatgacaccattctgaatgacataaagttagcagattgtgaacagttccagatgccggatctgtgtgctgaagagatcgctattattcttggaatctgcactaattttcaaaagaataacccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggtggcacatgatgttcacttatcctgtcactggggatgttatttgatcattcagtaagcttgtgtttgtgagatttctccccaagtaaagttactctactcttttcccattgtaattaataaacattttcaggaagtga

SEQ ID NO: 12920 - DNA, 637 bp, Homo sapiens
gcagctcggggtgtggttttctctcggttgtgcctatttggccttggaagactatcaaggttcagcaaaggcatttcagcgctgtgtgactctagaacccgatgtctgtgcatattccactgtcttgtttacagaaactttgtagtaagttttgaaaatgctaatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtaggatattcctattccgttatttcagtttgtgtttgatactaatccttgatcatatggtataaattatttccttgaatatgcacaggaaaattttgttaaacacatgtaacatatgaaaagggtatttttttctagtcaaatattcttcatgatatatagaattctgctattctaatgtcaaatttgtttgtacagtcataaactgaatattactctgactcagttatgaaaatctccgtgagcgggtacatat

SEQ ID NO: 12921 - DNA, 251 bp, Homo sapiens
ctttgctttttaaaaattatatttcattagctacaacatgcatcttataattaatttacctttttttcttaatttaaagcactaattttcaaaagaataacccagtgcacacattaactgaagtggagcttctggcatttacatcagtgagtaatgtctttttctcttccatttcatttttttcctggtaaattacttcctctggtatggtcttgccttggattgtttatgttgaaacactgccacctaag

SEQ ID NO: 12922 - DNA, 2922 bp, Homo sapiens
ggcataaccacccaacaggctccttactcaagctcgggttcttctcctaggcggaagccagaccagagagcgtgcgtgtttttcccagggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcagagagtggatctttcctacaattgctgctggaagggaactatgaagccatattcttaaattcaatgactcaaaatatttttaattcaacaacaaccgctgaagaaaagattgatagctacctggagaagcaggtagtaacattcctggattactcaacagatttggacacaacggaaagacaacagttgatatttctacttggtgtgagcagtttgcaactttttgttcagagcaactggacggggccccctgttgacttacaccctcaggactttttgtcatctgttttgttccagcaattcagtgaggttaaaggactggatgcatttgttctgagcctgctcactctagatggtgaatcaatctacagcctgacctcgaagcctatactactgttattagcacgcattatcctagtgaatgtaagacataaactgacagctattcagagcttgccatggtggactttgagatgtgtgaatattcatcagcatttgcttgaggaacgctcacctctgctttttactcttgccgaaaactgtattgatcaagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtgctttgggaaaaagaacacggttccaggaaaattatgtggcacaactgattctagatgtaagaagggaaggggatgtcctttcaaattgtgaattcactccagcacccactcctcaggaacatttaaccaagaatcttgagctcaatgatgacaccattctgaatgacataaagttagcagattgtgaacagttccagatgccggatctgtgtgctgaagagatcgctattattcttggaatctgcactaattttcaaaagaataacccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggctcttgcagaccaatttgaagataaaactacatctgtattggaacgcctgaagattttctattgctgtcaagtaccacctcactgggccattcagcgccaacttgcaagtttgctctttgagttgggatgtaccagttcagcccttcagatatttgaaaagctagaaatgtgggaagatgttgtcatttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcagctcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagtgctttcacctgctggtaaaagatacatctgtatatctgaaatgcaagatattgatttttaaaataaatttgttttatgacttaaaaaaaaaaaa

SEQ ID NO: 12923 - DNA, 1641 bp, Homo sapiens
  misc_feature (79)..(79): n is a, c, g, or t
  misc_feature (96)..(96): n is a, c, g, or t
  misc_feature (117)..(117): n is a, c, g, or t
  misc_feature (132)..(132): n is a, c, g, or t
  misc_feature (146)..(146): n is a, c, g, or t
  misc_feature (175)..(175): n is a, c, g, or t
  misc_feature (193)..(193): n is a, c, g, or t
  misc_feature (199)..(199): n is a, c, g, or t
  misc_feature (207)..(207): n is a, c, g, or t
  misc_feature (216)..(216): n is a, c, g, or t
gtgggctgcggcggctccaggtacctgcctgaacgtggcactgcgcagtctgcccccgggtcgcaggggcgctcctgancttcgcggggccgcctntagggctgcctgcgcggaganccgaccgcggccgangtcggtgttaagtngccgccccggccggctacccggagccaanaacaggcggcgcactgancgggangtggccangctggcgangcggctcttgcagaccaatttgaagataaaactacatctgtattggaacgcctgaagattttctattgctgtcaagtaccacctcactgggccattcagcgccaacttgcaagtttgctctttgagttgggatgtaccagttcagcccttcagatatttgaaaagctagaaatgtgggaagatgttgtcatttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcagctcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaaaaaaaaaaaa

SEQ ID NO: 12924 - DNA, 1038 bp, Homo sapiens
gcagctcggggtgtggttttctctcggttgtgcctatttggccttggaagactatcaaggttcagcaaaggcatttcagcgctgtgtgactctagaacccgatgtctgtgcatattccactgtcttgtttacagaaactttgtagtaagttttgaaaatgctaatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaaaaaaaaaaaa

SEQ ID NO: 12925 - DNA, 1157 bp, Homo sapiens
  misc_feature (339)..(339): n is a, c, g, or t
  misc_feature (367)..(367): n is a, c, g, or t
  misc_feature (370)..(370): n is a, c, g, or t
gcagctcggggtgtggttttctctcggttgtgcctatttggccttggaagactatcaaggttcagcaaaggcatttcagcgctgtgtgactctagaacccgatgtctgtgcatattccactgtcttgtttacagaaactttgtagtaagttttgaaaatgctaatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgagctgtatctcggcggcttaattgcgaacaaaggnggattgacgggacggcacatggcaacgnggnacacccccccccccccccccgcccgccgcggccgggcgggcggtggggggtggggtgggggggggggggtggggtgctgagggcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaaaaaaaaaaaa

SEQ ID NO: 12926 - DNA, 1334 bp, Homo sapiens
actcggccaaaaggccagtcctggaaataggtgagagtgggcaggcccttggggaagtgaagctcttgggaagctctgacatccagttggacatccagaacctttgcttcctgaatcctggttcttggctggactccagagggtccttatgactattgcttagaatttgatgcataagctgtatgtttttcaagcactcctagaaggaaacacttccagggtaagcctctcagaggaaggctcacatcttacctctgatcttcccctaaataatcaccagcaggtgaccatctctttgcagcctttctactaaggagccaaggcaagagtattactcagatattgaaaatggatctcagctgtgcccctcgccttttctcccacgactcgtcatctgtgatgtttccaccagctttatttgcagagcacagaccacagggagccagtgtcttgggttagggttgtcttcacctgccctcgtctccaggcacgagaggcctgagaggctgctcaggagctaaaacattgtgaatgtccattcttgtaaaggatcaggtaccttagtattcggcagtttacatgattcaaagcacctgtgcatgttttcctctttctctagttacttgcacacttgtctggaaagaccttgtggggtgtagaacacaacagtgttcatagctaggccagtctcagcagtgtcctagcccattcagaggccatctggtgatagacccagcatgtttttttcttatggcagcagaaagattgaatagcctttctgctggattctagacccccaaaaaagaaaaataaaatcccagtgggcaaactcccaggcggtggtgatcactaaaatctgtcacagtcttcagtgaacaaaccccacttgctgttcctggggttgctctgctgccactccccatccccgcttatttaaagaactgctgtgaaaaatcagttccagtttcttctgtaaaacccacggcactactggtgcattctgagttacacttgttaagtagaaccttcttattccctaagagattttcaaaataagtcacttattcctgttaacatcgccctttttgtcaataatcaaatcaagcaggttgtgtttttttatgtaagaattccaacaagaagatgtaaaccaccaattcaggattgttttcactttctttttttgagatggggcctcactctgtcacccaggctggagctagagtacagtggtgtgatctcagcttactgcaaccacctcctgggctcaagcaatcctcccacctcagcctccccagtagctgggactacaggcatgcaccaccattcccagc

SEQ ID NO: 12927 - DNA, 250 bp, Homo sapiens
tgcctcagcctcccgactgggagtactggcatgtgccaccatgcttgtctaatttttttgtactttttagtagagatgagattttgccatgttggccagtgatctgctcacctcagcctcccaaaatgctgggattacaggtgtgagccactgcacctggccagcacttcacttttgagtgtcctagttggacttaattctttccttagaccatctacctgggtcgatcaatcagtagagttctttaaac

SEQ ID NO: 12928 - DNA, 2383 bp, Homo sapiens
  misc_feature (2383)..(2383): n is a, c, g, or t
gtggagccagtgtttttgtatgaacatgatgaactactgattaaaactttgatttgtaaattcctggggtgagttgatctgaattgtattttattccactgcctacataaatccatagtgctctgtgaagcatatgaataacatcaccgtgctgtgcttgaaggggagtgaagatgaatggtattgattgttatctgcatcaataaatgagatattctgattatggtacagtcagcagaagggaattgaaggcttaagattttaatatttccttcaaggaatttatgatttgatgtcagtagttcctcacattttttaataatgaaggctcctttcaatatcaagatattttatagatctccacatgataacctgttgaactttttgagtatctgttgatcaagaaaataaagtcaaaagctacaattaattagtaatgtgctcaaaataaatttgtattttataaatcataacatcttttccatgttactctgtctatatggagttcttaataccacacatttgcttagggagatggaattagcaactagtctgtgctaccctgtattttttttttaaccatgtagttggattttttaaaatacaataaaagagttcacttttccaggtttgacaacatttttatgaattggaaattttctgtggctacagatactattaacattttggaaaggtgtaaagaacattgttttaatgtaaggctcttctctaacctccctcccctctccaaattctccataatatgaagtaggaagatatgtatttttctgttgccattaaaatgttctggccatcgtgggagtggggatggggagggcggggatgggaattagaacttactagaataaaattccaaatagaggtttggggaaacctacttgtgagtgctttttaacctcaaaataaggatttggggtgggtggagaaggtgatggggcagaagaagttgtttttggaggagagaaagcagattgaaaggaaaaggacagctgatagccacttaaataatgtcatcgttagagtgatacctattttttgtaaaaagaaaacaatatgctccattcttacaaagcattgattgtattttaatatatacaatgtaaatactatcatgcagtggtgtccaagggagagaatacagtcatgagttcttagtttctgttattggttgggccaataaagccccttcatcatccttcttttctgcttatcactagagacagaaactaaaaaccatggcttcaggctgctaaaagcctaaaacaaaacagaacaacaacaacaaataaggcaggttggacaagcttgctgagtatttgggagcctttttcaaaagtctgatttgggggaagtaaagtcacttattttaagctaccttagtatagcacctaaagagttactttgtgaattttgtatggctgcaattgaaaaaaaaaattgctcactttcacttgcatttaaaaatcagagctctaaaagttaattcttgttttttattgggaaactctgagagaaacattaattgatgagggtaataattttggtataaagccagtgaaattttaatgcttaacatgttgggttttttaaaattactgattgaaactcttccttttctatttaaagatgatgaaaaagatgagcatacttctaaaaagcgcaaagtagagccaggagaaccagcaaagaagaaaaagtagaaacaaatgaccagaatttctgtactgctaaacttgttgaaatgtttctttggacagattaagttgatattgtgggttattatgccacatctccatgaaaatgcatacgttaatgaactaataagtattgcctcaagaactttccactatagaattctttttttatttaaaacatgtatgtatttaaaactcaactggtgacttgtgattgtgaaattgataacacttggatgcattcttgctctcacagaattggtgacatgctttgagagttttgtcacatgttgacatgccaatgttcttataaaccttttataaaggaatatatttttaaagtaaatatattgtaatgtactgtgaacttgtagggtgcttttcaacagtctttgtacagtgtaaatagatcatggaaataaaattacttattcaatattactattactgtataacattaacatttgaatgtttgtctgtgacaagtaccctatttgtcgtgtgacattttaagttgtaataagaagtattaccatttaaagagtgcctcctgtgttccaggtgctttgtgcatatattttctctgatccttaaacaacctagcgcaaggtattattagtattctcattttataataaagagtgcttgagtagcttgtctgatgttan

SEQ ID NO: 12929 - DNA, 1223 bp, Homo sapiens
  misc_feature (1223)..(1223): n is a, c, g, or t
cgctcgcagccgtcatggcagcggaggagaaggaccctctgagctattttgcggcatacgggagcagcagctcaggctcctcggacgagaggataacatcgagccggagagacgagtcgcagaaccccggatccggcgaagtcggcgggcggctgtaggaacaaggcggagaagcggctcccgggacctgacgagctgtttaggagcgtgactcgcccggcctttctctacaatccgctcaacaaacagatagactgggagaggcacgtcgtcaaggcgcctgaggagcctccaaaggaattcaaaatatggaagtcaaattatgtaccacctcctgagacctacaccactgagaagaagcctccgcctccagagcttgacatggcaataaaatggtctaacatatatgaggacaatggtgatgatgctccacagaatgctaagaaagctaggcttctaccagaaggggaggagacgttggaatcagatgatgaaaaagatgagcatacttctaaaaagcgcaaagtagagccaggagaaccagcaaagaagaaaaagtagaaacaaatgaccagaatttctgtactgctaaacttgttgaaatgtttctttggacagattaagttgatattgtgggttattatgccacatctccatgaaaatgcatacgttaatgaactaataagtattgcctcaagaactttccactatagaattctttttttatttaaaacatgtatgtatttaaaactcaactggtgacttgtgattgtgaaattgataacacttggatgcattcttgctctcacagaattggtgacatgctttgagagttttgtcacatgttgacatgccaatgttcttataaaccttttataaaggaatatatttttaaagtaaatatattgtaatgtactgtgaacttgtagggtgcttttcaacagtctttgtacagtgtaaatagatcatggaaataaaattacttattcaatattactattactgtataacattaacatttgaatgtttgtctgtgacaagtaccctatttgtcgtgtgacattttaagttgtaataagaagtattaccatttaaagagtgcctcctgtgttccaggtgctttgtgcatatattttctctgatccttaaacaacctagcgcaaggtattattagtattctcattttataataaagagtgcttgagtagcttgtctgatgttan

SEQ ID NO: 12930 - DNA, 2548 bp, Homo sapiens
aacgattgtcgttacagcgaacagtttggccccgtttgtaaaaggccgcggcaggcgaagagagaagagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcactagtttttcctaatt

SEQ ID NO: 12931 - DNA, 2708 bp, Homo sapiens
cgcgcggggaggatgccgggaagcaggtcccaggggatatgtgtgtgtcgctgcagacccatcccggaagccggccgggaggtgagcgtcccggagtcgggcggccgctccgttgactgcagggccccggcggtcttcctccgctgttccgaggccgttgagggctgatgtgctccatcctcccacttgtggtttggcaagccatccagccgactacaaacccacgtttactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcactagtttttcctaatt

SEQ ID NO: 12932 - DNA, 2560 bp, Homo sapiens
cgcgcggggaggatgccgggaagcaggtcccaggggatatgtgtgtgtcgctgcagacccatcccggaagccggccgggagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcactagtttttcctaatt

SEQ ID NO: 12933 - DNA, 2603 bp, Homo sapiens
aacgattgtcgttacagcgaacagtttggccccgtttgtaaaaggccgcggcaggcgaagagagaagaggtgagggcggtcgtcagctaagggccccggggctcgcggggggtgcgcagggcagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcactagtttttcctaatt

SEQ ID NO: 12934 - DNA, 2563 bp, Homo sapiens
aatgtatgtaacactcaagcacgtcccgtgtaatttcggcacgatggtttgtaaccaggccgctatacgtgagccagagaagagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcactagtttttcctaatt

SEQ ID NO: 12935 - DNA, 2334 bp, Homo sapiens
aacgattgtcgttacagcgaacagtttggccccgtttgtaaaaggccgcggcaggcgaagagagaagaggtgagggcggtcgtcagctaagggccccggggctcgcggggggtgcgcagggcagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcactagtttttcctaatt

SEQ ID NO: 12936 - DNA, 2073 bp, Homo sapiens
cgcgcggggaggatgccgggaagcaggtcccaggggatatgtgtgtgtcgctgcagacccatcccggaagccggccgggaggtgagcgtcccggagtcgggcggccgctccgttgactgcagggccccggcggtcttcctccgctgttccgaggccgttgagggctgatgtgctccatcctcccacttgtggtttggcaagccatccagccgactacaaacccacgtttactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacaggtacaggatttccctttggtatagtgatggatgtctcgaacatagagaattatgtttggaaaaaatctgtgtggaatattcaccgtgagtattcagagttaggacttctactcacatgtctggagcacaaagccttcaatgatcagcatatcaattatctacatcaactgatttgtcaccaaaaccttttatatatttgcctctagaatttctttttaaaagtgctgagaatctataaggaaataatagtactgtattagaaactaggtaacaaatacaacaaaagaaaatgttattttttggtaatctaa

SEQ ID NO: 12937 - DNA, 561 bp, Homo sapiens
gatgaggcacaagtgactttatccttccaagactggctggccagtgtcacagaacgcatccatcaaaccatgcactatcagtttgatggtaagtattgttcatctaactgggctcttgctgaaagtaggagaaattaaggtaattgtgctgtaattctcctctgataggaaaagtaattggacttcagtccagagagcactgggccacaagaaagtagaaatctaattgaaagaaaaaaacaatcacatagttaaaattcaggcgcagcaaaattattataatttagagacagaagagaaaaaacatagcaaataataagtaaaggcaggtagtcttattgcttgcataagttcgtgtgcacgtgtgtgtgtgtgtgtgtgtgtgtgtgtgtgtgtggtgagggagatactgaagctttatgagactattctaactctcaaacttaaagcaaggggaaaaaagattagagaaaatctaagcctgcacaacatagtgaaccccatctctacaaaaaatagtgccattgcactccagcctgggaaacgaagcgagaccctgta

SEQ ID NO: 12938 - DNA, 711 bp, Homo sapiens
actgaacaaatcccatccttctttcacaccggtacaaattctatttcttatagaactttctggtcatcctggcccatatagactttcccctattctgaactctttagcatttacttattcgactggcactgatcatatgaatgcatattattatttttctttttaggtatatatcctatacttgccaacttggtggacactgagaacaccaatctaatactaaggttaaaagaaggtgctgaatatggtcatccctcagagggtcaatagcatgagaaaagacattaattaacaagtgaagggtacatagacaactcaagtagatgaacaagctcttttactcttgaggctacttttaacttttgaattgttcattccttactgggagagagaacatctcacctctctctctgagtttagctcttagagaatgcttggtaaacatttgctaaactgcatgttaacaaatttgtcactgtagctctaaaagttcctagcctcatcaacatgtaagaaggtattatcaaactgatgcaatgtcctgaaatagatggtggatgtcaatttaccccacccgaatgatgttaagacacttacagttacacactcacagcacagcagaaccagctataacacgtttgtttatattattgagaaagacattgccaagactgcttcttagcttcaatgttctaaaacttaagggcaatg

SEQ ID NO: 12939 - DNA, 619 bp, Homo sapiens
ttcgagaccagcctgggccaacacagtgggaccctgtttctacaaaacaaataaatagaaataaaaaaggaataaattggttcatgcaacaccatggatgaagctaagcgagaacaagccagaaacaaaagactgcatgctttgttattccataatggtctagaaaatgcaaactatagtcacagaaagcagaacagtgcttgccagggactatagatgagggaggggtagactgtagagggcatggtgggaagattctgtatcttgactgtggtggtggatacatgactatatacagttgtgggaacttgtcaaattgtgcacttaaaatgggtgagtagtattgtatgtaagtaaataaagctgatttaaaagaaaaacaccaggagatgacatttcatgaggcatgtgctaattaaaatcacaataagataacaccggaatagttaaaagggcagccaagaccaagtgttagcgaggaagtacagcaattggggcatttatacatggctggtgttgagtgtaaaatggttcaacccctgtggaccactaacagtttcttagagaagctgacatatatctacctatgactcagaaattccactccccggtattctct

SEQ ID NO: 12940 - DNA, 416 bp, Homo sapiens
ctctggcagggaggacgtgctcatctctggtacctgaaaagaagttgcccatgttattttcgctttatatgtgacgaaacaaacatggtgcacttctttttcggtatcaaatatctccttgaagtgcctccatccccgacgggaccctgagcatgggacctggtgtcactacctctcttggtatgtacatggaggatttgtcctggcagcccctcggtgactttgtgtgttggtgggctcagggaccatgctcagtcctcagtcctcagtccacgcccacctctcggacaggcacagttggcgaggcctcaaccacatgccagttccccgctgccagggaggctggggagatgcacttccaggctccattgagaagcgttccccaacatttgagaagagttcagatcatagcagcc

SEQ ID NO: 12941 - DNA, 324 bp, Homo sapiens
caagaattcactcaacactttgaaatgataagaaattagagctctttagtctcatctacctatattttgaccaactcaattgtaaaacccttgagaataatacatatgtgctgcttttataatttttacattaacagtgatttatataaatactcaatacatttcaataaatacttaacattaatgctcaggctttatgtcccaattttttttttagacaaaaagtaaacattgggtcatatttattatacacttttttgtcaggtttaaactaaaatacaatctcatttgaaatttaataaagtattttcacactccagaaat

SEQ ID NO: 12942 - DNA, 513 bp, Homo sapiens
ctgttttagctcatctgttatagatggatgctctgtcatggataatttatccatccttcttgtttgcctttctatgtgcaggccgttcataaaattgaattgtttgcctctgtccacactcatagtaggtgctgggagggatttgaaaagtttgctgggtgacatttcattggaagtgaaaaatgacctgggggtggagccccaggggtgtgtgtgtcaaaccactgaaagggatggcaactttggctctgtagggggctaattcatacacagataaatgatttaattgtaattaggcagcaatttaaaatgacactaataaccctcagaccatctttatgttcgctaacaaaaagattcctgtttgtctttatttcccctaagttatgggtatctttttctataaaatatataaaacctttgccagatgattcattggttaagcctatactttttaagccgtaattgattgggtttttatttagtagaaaggtagtatatagcattgtacac

SEQ ID NO: 12943 - DNA, 573 bp, Homo sapiens
acagcatctccaggagtcaacacccaggcagcattcctctcttcttgtgtgaatttctgcaggttgtcagcaatctgagggcaacgtcttttcttagggaaagctaagatattcagatttaccccagagtgggtatcaaattatctgtgggtgtaaggaatacacaatggtagagattttattcctaatgagcagagactggaaacacatttggaagtatatcatgatgtttcttttcctacctcagtctagtgatctcattgggttgaattctctgtggtttggcttcaaactcttttcattccaatcttcgtcttttcaatttgctgccccattttatggtctacatctttccttcaaagatcctgctgcttttcatcttcttgatgcctcatcatttattcaacctgttgcgtgccttctctgtgtcttccctccatttcattttataaggcattttagtgcattgtatgtggcaaatgggggaggagacagaatgaagagagaccagtaacccttcccaggccagtttatacagttttcctaaggcttcccatatatttaatactaaat

SEQ ID NO: 12944 - DNA, 406 bp, Homo sapiens
atcctgactgtatttttggctgaaagactttcctcttggctgcatggtaagggaacaggttaggggaagccaggctgtaggggtcagaggccatcagggaaattgcaggttgcactttcgtgcttttgggtcactggggcaggtctggagaatgtcttggaggtagacagaagctgctgagtctgagagtcccttgcggtgcctttttccctgacttcccatgttgggccatgtcccttggaatggagactcccttgtctccaggctggctcaaggctgaacttcaggcttggaaaacagagaattagaaccaaattcctcactttgggaagccaaagtgggctgatcacttgaggtcaggagttcaagaccagcctggctaacttggtgaaaccccatcactact

SEQ ID NO: 12945 - DNA, 156 bp, Homo sapiens
tgttgtccagttgtatcaggaagggagtacagtgtaatggttaagtgacctccagaaacaggtagcttggatttgaatctcagttaaaccacttagtagctgtgtgaccttggacaagttatctaacttctttgtgtctcatctgtaaaagaaaaa

SEQ ID NO: 12946 - DNA, 529 bp, Homo sapiens
cccgtagaggcagaaggtgaggcgtctacgccctctctcaccagattttgggcggccctgtggagacaccctgtgccctttaagggacatggattgagtcgggatctcaaaatgtgagcctttcctcagacccagctttgacccacgtactcgcctttcctcaactcattttcatactttcacttgactatatattttttaaaaattgtgttaagcacttgaggttcatttctgcccctactgtatgtgcaccctgtgccagagggtggggtgaacacgtgtgtagcagtcatgcgtcctgtccacaggggccgatgcacctccttgcaaccctttacattccactgtgaaacaaacctcaactttttcttattcctgtttttacaccgtgcttatagctgccttaatccatgttccttcgggatgctggtatccaactgagaagttgacggagcatctatcgtgtgccagacactgtgctaagtgctaacgagaaatcggtgagcaaaacagaaaagaaaaaaaaaaa

SEQ ID NO: 12947 - DNA, 330 bp, Homo sapiens
acgtatgctgagatgatttaaatcagtgagacagactttccttatgatgcccacacccaacacagaaggaagccgaggtcccaggaaattggaatagcaggtacacgtctcaggtgtgcaagaaatatcacaagaatgtaacttctgttttgagcccccatttttcctgagtgccagaaaagatcatttgtccatttgggattccttctctttccatgagggtcatagctgagttctgagggtcttacataatgccaagaagttgggagagcattctcactgatcaccagtgtccatacttcatccatccccgggatttccatcattcca

SEQ ID NO: 12948 - DNA, 629 bp, Homo sapiens
tctgttgggagagagagagccaggggtgatggtctggctttcagacctgagatcagacaggcagatagctgaactcccaggcagttcgttggttggtggttggttttttgctaggttttagttgtttttttgttctgaatctcatttcaaagagagcagattgactccacacctaatgcacatcctcagtttcacaaagcagctaagagcaagtcaggtttcatagtccaaatgatgctattgcttgagtgtaattgtgcaccagccattagcccacatttcttggtagagcctcggtgcccttggattatgaatttgcacacagtggaatcgcaacaatttgttttatagttctgtcctttgagggagtgacatttcttccaaggtctcagctcctttaatctataaaatgggaataataagaattcactggacaaatattcagtgtgcctgttgggagtgttgggcatgtgcagtccatctctggggctagcatggaaggcgtacattaaaaagatactcatgctggctgcagtggctcgtgcctgtaatcccaacaccctgagaggctgaggtaggtggatcacttgagaccagtctgggcaacatgatgaaactctgtctctata

SEQ ID NO: 12949 - DNA, 1037 bp, Homo sapiens
ctgcctcagcctcccgagtagctgggactacaggcgcccgccaccatgcccagctaatttttttgtatttttagtagagacgaggtttcaccatgttagccaggatggtctcaatctcctgacctcatgatccgcccgcctcagcctcccaaagtgctgggattacaggcgtgagccaccgcacccagcccgtatttttttttctaacaaatacctggtgttaagcccaaagtgtgtgtttctggttggctggtgatgctctttcaagtcctgaatcagggacccaataactttcaacattgtggctcagctctcttcaacagctgcctccaagttctcttgagatattggtatttatcagaggagaggggatggagaaggtatatgcctttgctagagctgccataacaaaggactgtagactgaggggcttaaacaacagaaatttatttccttacaatcctggaggtcggaagtctgagatcaaggtgtgggcagggctggttcctcctgaggcctctctccttggcttgtagactctgtgttctccctttgtcctcatacagtcgtctctctgtgtgtgtctgtgtcctcatctcttcttatgaggtgtcttagtccatttcaagctgctataacagaacaccatagactgcagggcttaaacaacagacatttattctcccattgtcttggaggctatctatctacctatgtagcatctatctacccatctatctatcatctgtgtataatctacctattatctatctatctacttatcatctacttatcatctacctatcatctgtctatttttctatctatcatctatctaccatctatgtatctacctatcatctagccatctgtcatctatcatctatcacctatcatctatctgtctcacctatcatttatctatgtatttgtgtatcatcatcacccagctatgaactatctatcatgtatgatgtatctatcatctatgtatctacctatctgttattttggtcaaatatacataatataaaact

SEQ ID NO: 12950 - DNA, 441 bp, Homo sapiens
cagctgcaaccttgcctcctgggttcgagcaattcttctgcctcagcctcttgagtagctgggattacaggcgtgcaccaccacacctggctaatttttggatttttttttttttttagaagaggcacagtttcaccatgtaggtcatgctgacctcaagtgatcctcctacctcggcctcccaaagtgtaggaattacaggcatgagccaccatatccggctaaacgtgacagtttcttacaatcccaccccagagataaccactgttaaagcttgttgaatatccccctagatctgcagttcacaatttttttggtctcaggatccattttccactcttaaaattggaggatcccaaaaaacttttatgtatgtgagttatatctattgatatttataatttataaattgagaaatctaaaaaacattttaatttattt

SEQ ID NO: 12951 - DNA, 596 bp, Homo sapiens
caaaacaaaacaaaaaaacaacagcataatgcctggcatatattaggtaagtgttagctacctccctgccgatatcagtgattttgaagtcttaagattaccacccctattgcttgtgattatgccagaagaaataatcactgcaggcatataggggtcttagggccagtccatactggtcctctacagatgagtctaattattcaacacaccaaagaaggaatctgtcattcacagagctgcacaaaagataacacacaggaatgtctatacatctacaaaaatgtgcaagatttatatgaagaaaaacttaaaacattactgaagggccaggcatagtggctcacacctgtaatcccagctctttgggaggctaaggtgagatcatttgagtccaggagtttgagaccagactggacaataccccacatctgcaaaaaattttcaaattagctgggcatggtgtgtgcctatagtcccagctacttgggaggctgaggcaggaggatcacttgagaccaggagtctgaggttgcagtgacctgtgactgtaccactgcactccagcatgggcagcagagtaagaccctgtgtct

SEQ ID NO: 12952 - DNA, 744 bp, Homo sapiens
aggctccttgaggccctggagatggaatgttgggcccccaagtcctgaaaggaaccagtggggctgtaatcttcacaatctggatccagccagaagagcactgagagctcagtgtttggaggacaaaaaagggcaatggatatacagtaacttagtgaatcagggcccggatccaggaagatgcctgacatttgtttatcagcagagaaacagaagtaaaggaggggaaccttctcctaagtgttactgtgttatgaaagtgtccttcagggagaggcgacatgaacagggcagctgataacgttgatactgtgcaggcacacatctccccacattccccaggctgctgaaccaagtgtaccaaactaatcgcaaggacacagctttgagcctccccggcggcagtccctggagagagtccgctcagacaaagcaaagcgcgctcccagcggggaggggtggccactttttctttgttctcccttggaaaatcggctgtctctcaagtctcgtaaaccagctgctttcacttcttgcagggggtcaaaatcaattaatcaccaatcatgtttggacagcacagttttgaagccctgaactctgtgaaatgcagggtcaaactatttttagaattttaacatgccgttaagtttgtattctgagtttcccagcaaaaatttctgaaatgtgccccactttgaaaaaataaaataaaaagaacacctccagaaaaaaggtggtgga

SEQ ID NO: 12953 - DNA, 294 bp, Homo sapiens
ccccactccccacaaggaggtgaagctgtctctgatggcagtgccgctgtcactgcctcggacgctggagcagagtagctcatggcaggctgcagaggaggggactccacaaggacaccaggaggcacagggtgcaccctgcagggcttggggcatggtccaatgaccctttcatggggcctgccagctgcaccagagcacacctgcccccataccagactcgtgcctggggtcctgcagggccactgcctctgaccagcccactgttggtgggatctgccgtccttgcagtgg

SEQ ID NO: 12954 - DNA, 290 bp, Homo sapiens
atggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgtta

SEQ ID NO: 12955 - DNA, 338 bp, Homo sapiens
aactccatgaagataaggaaaaatcagcgcaaaaatgctgaaaatttcaaaagccagaatgcctcttctcctctaaatgatcacaacaactctccagcaagggtgcaaaactggacagagaatgagattgacgaattgacagaagaaggcttcagaaggtaggtaataacaaactcctcttagctaaaggagcatgttctaacccacatgtttgtatgtttcacacatttacagttacaaattataaatcccaaatcctaagactcatatgatttttaaaattatgtaaaatttctgctaacaaaataccctgattatgttattaggacattcaaaat

SEQ ID NO: 12956 - DNA, 4119 bp, Homo sapiens
  misc_feature (3939)..(3939): n is a, c, g, or t
agtcagaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttgcatcagatgaagaagaaccaacttcagcaggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattntccaaggaagttgattaaattctatttgttaccttttagaaaaaagcattgaaatgagtttctcttgcttttcattttccctctgctttatatgctcttcgcatacatcatgtccacgggatcctattgttctctgaacccaattgtggagccgggtcgcccttggatgttgacctttgg

SEQ ID NO: 12957 - DNA, 2719 bp, Homo sapiens
agtcagaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttgcatcagatgaagaagaaccaacttcagcaggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcaca

SEQ ID NO: 12958 - DNA, 4089 bp, Homo sapiens
  misc_feature (3909)..(3909): n is a, c, g, or t
agtcagaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattntccaaggaagttgattaaattctatttgttaccttttagaaaaaagcattgaaatgagtttctcttgcttttcattttccctctgctttatatgctcttcgcatacatcatgtccacgggatcctattgttctctgaacccaattgtggagccgggtcgcccttggatgttgacctttgg

SEQ ID NO: 12959 - DNA, 3261 bp, Homo sapiens
  misc_feature (3081)..(3081): n is a, c, g, or t
agcggaatggatttaggacctctgtattcaacattcctatcacttttgtaggtaactgtgctattgcataatatggccatacttaagtcattttccttgagaatagagaagtaaaggagaaaccaatgatttttcccccacttcagatctcacctgccagcactgatgtaagacttcacctccctatttcaaggcacattattatcatcagtctggataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattntccaaggaagttgattaaattctatttgttaccttttagaaaaaagcattgaaatgagtttctcttgcttttcattttccctctgctttatatgctcttcgcatacatcatgtccacgggatcctattgttctctgaacccaattgtggagccgggtcgcccttggatgttgacctttgg

SEQ ID NO: 12960 - DNA, 3203 bp, Homo sapiens
  misc_feature (3023)..(3023): n is a, c, g, or t
aactccatgaagataaggaaaaatcagcgcaaaaatgctgaaaatttcaaaagccagaatgcctcttctcctctaaatgatcacaacaactctccagcaagggtgcaaaactggacagagaatgagattgacgaattgacagaagaaggcttcagaagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattntccaaggaagttgattaaattctatttgttaccttttagaaaaaagcattgaaatgagtttctcttgcttttcattttccctctgctttatatgctcttcgcatacatcatgtccacgggatcctattgttctctgaacccaattgtggagccgggtcgcccttggatgttgacctttgg

SEQ ID NO: 12961 - DNA, 3993 bp, Homo sapiens
  misc_feature (3813)..(3813): n is a, c, g, or t
agtcagaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttgcatcagatgaagaagaaccaacttcagcaggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattntccaaggaagttgattaaattctatttgttaccttttagaaaaaagcattgaaatgagtttctcttgcttttcattttccctctgctttatatgctcttcgcatacatcatgtccacgggatcctattgttctctgaacccaattgtggagccgggtcgcccttggatgttgacctttgg

SEQ ID NO: 12962 - DNA, 2457 bp, Homo sapiens
  misc_feature (47)..(47): n is a, c, g, or t
  misc_feature (2277)..(2277): n is a, c, g, or t
acgtcgaacacgctccataccctacgagcgccaagcgacaccaaaancccttaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattntccaaggaagttgattaaattctatttgttaccttttagaaaaaagcattgaaatgagtttctcttgcttttcattttccctctgctttatatgctcttcgcatacatcatgtccacgggatcctattgttctctgaacccaattgtggagccgggtcgcccttggatgttgacctttgg

SEQ ID NO: 12963 - DNA, 498 bp, Homo sapiens
tgtatttgacaattacaagtgaagaattaaactgaacaaaatatctccaatggtctcatgaactctatcaggtaaacaataatatgaacacttaacagctgcaaagccctctggtacaacgcagggtagggtaagaagaaagtcaggagaacagtacaaaatgttaggagaaggaaaaggattaaattgcccacattgacctgaaaagaacttctgaaaggatggcatttgggtcaggagttgaaggaataatagctttttggttgtggagaagttgaatttcactatgagggttgggaccattcacgtaaatattgatcaataggtacagatcccctgttatataccagggactagacaaaatgctcaagatacagcgtggaacagatgactctcctcatagtgtttagttgtagaagagactgaaaaggtgaaagtcattggtaatcctactacccagtaaagacccaatgaatatttgttccgtttaaaaaaaaa

SEQ ID NO: 12964 - DNA, 415 bp, Homo sapiens
ccaggagttattgtgcctttgttttctaacgttggcttttgcggatcataactaggaaggtagagaaagtagatttgctctaagaagatccattaaagcatttagaagaataataaagaaatgaacatgaggctgggcatggtggttcacgcctatagtcttagcactttgggaggccgagatggtcagattgcttgagctcaggaattcaataccagcctgggcaatatggtgagacccccatctctactaaaaatacagaaaaatagctgggtgcggtggtgcatgcctatggtcccagctactagggaggctgaggtgggaggatcgcttgagactggggtggtggaggttgtagtgagccgtgattataccactgcactccagcctgggtgacagagcgagaccctgtctc

SEQ ID NO: 12965 - DNA, 429 bp, Homo sapiens
gaaggaaggaaggaaaaccttaacatctagaattttagagaacaagaacgtgtttatttgaaagtaggctctaaatgttaaggtatcttcccttgcacttcaaaataatatggcgtgcatgcaataaataagaaatgcagccgggtgcagtggctcacgcctgtaatcccagcactttgggaggtcgaggcaggcagatcacgaggtcaggaaatcgagaccatcctgactaacatggtgaaaccttgtctctactaaaaatacaaaaaattagccgggtgtggtggcgggggcctgtagtcccggctactcgggaggctgaggcaggagaatggcgtgaacccaggaggcagagcttgcagtgatctgagattgcaccactgccctccagcctgggcaacagagtgagactctgtctcaaaaaataaa

SEQ ID NO: 12966 - DNA, 253 bp, Homo sapiens
tcacacacttccgtatccaattcagtcacaaatgttgctagtcttctacctttgtaagattttgaacatcaccactggtctaagccatcattctcttttctgagaaatattgaatgatccttctaattggccttcatgctttctttcttgctttccttctgtgtaacaacttggaaagaaaagttccaaacctatcacagttaagcattaaaagtgtttgcttacataataaagaatgttggaaatttctcat

SEQ ID NO: 12967 - DNA, 1899 bp, Homo sapiens
caataataatattataatgtgtttctcttctaaaataaacagattttatactcattattttaaaatgtgatcaaaaccacataattgtttttagtcttctgattgcgatttttaaaaagaaaattcaaagtttggcattaaatatattttctgtaagataatataactacatatgataaaatgattaagtactctgatagtgtcactatttcaataccattattatctttaacatatgttaaaacactccagtacataactaataaagaggaattcacatggccagcaattttaaactggtgcagcaaacttatcttttgtgtttgcaaacataagagaactgaagaagcaagatgcaaacaatgtctccgttgttcagcatgtgttttatgatataatacattcgttcatgttgtgttatacaaattttgcagggagggttgctcgttttatcaatttgtgtattttttatttcatattttgtacgcaatcatgagcatttttcttataaattgtacacaacaagaacctgttgaagattagaaggaaggagcagcacatacttttagcaatccttttatcttaccaatcactggaagaaaatgatgccaagaagccatgtgagatatcatctctgtctgtcatgttttcagaacagagtgtggcttactaatgttgccattgcaggctatgctttgtcaagtgaatacggttttcatcttaaggggatagtaagcaagatgttagcaatactcactcatcttcagatttcattgtcaaatatactaatatttcaaaaatatggttttcatctagaaaaaaatggagattttgagtgtacaaatatagccaatgcaggttaaatttaaacagagatttttttttaatctctcccttttttatacttttttttttttttttgagacagagtcttgccctgtcacccaggcttcagtgcaatggcgcaatctcgactcactgcaacctccgcctcccaggttctagtgattctcctgcctcagcctcccaagtagctgggattacaggcacgcgctaccacacctggctaatttttgtatctttagtagagacaggtttcaccatgttggtcaggctggtatcgaactcctgacctcatgatccacccgcctcggactcccgaagtgctgggattacaggcatgagccaccacacctggcccccctttttatactttttacaagtaatctgacactaggtgccacataattaagataaagacaaaagtgcaaaaccatgtaaaatattgacttctaattgtgaattagtttcccttttctacttgttttgccttgttggatatgaaacatttcaagtatgtcattgtaggattatttttgacattttattcttagaatggtgatttagttgcataattctcatttgctataccacttttctaaaaaataaatgtttgaattattgaaatatcccaagatactccttgttatataattgtagatcattactttattttcagacaaattatgctattgtggataaatattcaatgtataaaatacaggacttcttttttcctgttttacaaaactccagtgccctttcttatctactattttaatattcctttgctatagtatattgcataatgtggagtcaactattttttacaatatgtacgtgttgatctgaaagttcctattgagttaaataatgaaaaataatttggtggaccatgaattttaaatttgttaaaaattgttttatttgtgtatgtgtataaaattaaattttgcaaattggtaaatttattcttcatttaaccttgttgctttgagtactcctaaagcttgtaataattctttggggagtaatataaaatatatcattcataagtga

SEQ ID NO: 12968 - DNA, 490 bp, Homo sapiens
ttattcctacgaaggccagtgcaggctcctgggctgcaaacaccaggccccagaaagacaattgcagccctctaccctctccctgcgtcaggcagcccacctgccttccccagggggctgctcctgctcacagagggatggccagcctggctccagagagctggaattgtcattgcagtgacaggagagaacagggctctcagctctggaaacagattcttatcctcatcttggtcttgggaattaggctggaactgggtgagaacaagcttcccagccacacaggcccaaagagagtcacagaagtacagaggccataaactcagccctttcccctctgactcccagatacggaggcgagaggctcaaagccagctcggcaaaccctggggactagctgtggaaagcaacttcaatgagatgcgtagaatgccaaaagttcagagtcaaagggcatccttggattcccaggctttttaggtttgtgttt

SEQ ID NO: 12969 - DNA, 882 bp, Homo sapiens
  misc_feature (833)..(833): n is a, c, g, or t
  misc_feature (835)..(835): n is a, c, g, or t
tgcaggctggtacggtccgagaggcgctagatccgcagcgaggaagcgcccgcgcgggcgcaggcggccgggatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccaatncntacagctcagagacgactacttccaagaggctcttaggaagcccctt

SEQ ID NO: 12970 - DNA, 236 bp, Homo sapiens
gaagaccaggctgaggctgtgtcgggaagccaggattccagaatcagcattcctcactggcctcacaagggaaagctgggaagcccggtgctggtgtgcagtagaaggacactcgtgaagtggtagccataaagtgtgtagccaagaaaagtctgaacaaggcatcggtggagaacctcctcacggagattgagatcctcaagggcatttcatcgacttggaatcctcgggatcga

SEQ ID NO: 12971 - DNA, 2812 bp, Homo sapiens
  misc_feature (2185)..(2185): n is a, c, g, or t
cggcgctgggggcagcgtggagccacccagtgctcggcccgccccgcaacccgccggaaccgccgcccgcagcgaggaagcgcccgcgcgggcgcaggcggccgggatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttctttgcgcacccctgggtggacctggagcacatgcccagtggggagagtctggggcgagcaaccgccctggtggtgcaggctgtgaagaaagaccaggagggggattcagcagccgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgccctggcctgcccttcccgggaccccttattccaactcagctcctctttgcactggaatggggcactccaacacccctcagngaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcattatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggagctgagtgtaaagagtatcattcattgtttctctattaaattattttctct

SEQ ID NO: 12972 - DNA, 2896 bp, Homo sapiens
  misc_feature (2269)..(2269): n is a, c, g, or t
cggcgctgggggcagcgtggagccacccagtgctcggcccgccccgcaacccgccggaaccgccgcccgcagcgaggaagcgcccgcgcgggcgcaggcggccgggatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcaggtgtgagcctggggcggggccgctgccaaagggagctggagaagggacactctcttcaggccgcctctctgcctctaaacacagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttctttgcgcacccctgggtggacctggagcacatgcccagtggggagagtctggggcgagcaaccgccctggtggtgcaggctgtgaagaaagaccaggagggggattcagcagccgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgccctggcctgcccttcccgggaccccttattccaactcagctcctctttgcactggaatggggcactccaacacccctcagngaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcattatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggagctgagtgtaaagagtatcattcattgtttctctattaaattattttctct

SEQ ID NO: 12973 - DNA, 2593 bp, Homo sapiens
  misc_feature (1966)..(1966): n is a, c, g, or t
ggctggtactggcctcgagattttgggaccgcagcgaggaagcgcccgcgcgggcgcaggcggccgggatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttctttgcgcacccctgggtggacctggagcacatgcccagtggggagagtctggggcgagcaaccgccctggtggtgcaggctgtgaagaaagaccaggagggggattcagcagccgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgccctggcctgcccttcccgggaccccttattccaactcagctcctctttgcactggaatggggcactccaacacccctcagngaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcattatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggagctgagtgtaaagagtatcattcattgtttctctattaaattattttctct

SEQ ID NO: 12974 - DNA, 2458 bp, Homo sapiens
  misc_feature (1831)..(1831): n is a, c, g, or t
ggctggtactggcctcgagattttgggaccgcagcgaggaagcgcccgcgcgggcgcaggcggccgggatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttctttgcgcacccctgggtggacctggagcacatgcccagtggggagagtctggggcgagcaaccgccctggtggtgcaggctgtgaagaaagaccaggagggggattcagcagccgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgccctggcctgcccttcccgggaccccttattccaactcagctcctctttgcactggaatggggcactccaacacccctcagngaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcattatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggagctgagtgtaaagagtatcattcattgtttctctattaaattattttctct

SEQ ID NO: 12975 - DNA, 916 bp, Homo sapiens
  misc_feature (867)..(867): n is a, c, g, or t
  misc_feature (869)..(869): n is a, c, g, or t
cggcgctgggggcagcgtggagccacccagtgctcggcccgccccgcaacccgccggaaccgccgcccgcagcgaggaagcgcccgcgcgggcgcaggcggccgggatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccaatncntacagctcagagacgactacttccaagaggctcttaggaagcccctt

SEQ ID NO: 12976 - DNA, 1396 bp, Homo sapiens
  misc_feature (769)..(769): n is a, c, g, or t
ggcttcctggaggaaggagcagataagggactcaggaggcaagttgttctgatggggcagagggttctggagagcatcaggggtgaggaggagttccctttgaaaccccaccccccgccactctcccccacacccaagggcatatctttccttggcaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgccctggcctgcccttcccgggaccccttattccaactcagctcctctttgcactggaatggggcactccaacacccctcagngaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcattatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggagctgagtgtaaagagtatcattcattgtttctctattaaattattttctct

SEQ ID NO: 12977 - DNA, 1450 bp, Homo sapiens
  misc_feature (823)..(823): n is a, c, g, or t
acatgggggccacgctggggctagggtctgtgggttctgttgctctctgcttgtggctgtcgtccccccctgctggtgtatgtctgctctctcgcctcctctgcaggcctccctgtccctgtatctgcccttcactctctctcttgctcggcactgcgctgtggctcgtgtccccgtccttcactctctcacttgctcggcactgcgctgtggctcgtgtgtctgcctctcatcccttgtgctgccttcacatcccacagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgccctggcctgcccttcccgggaccccttattccaactcagctcctctttgcactggaatggggcactccaacacccctcagngaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcattatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggagctgagtgtaaagagtatcattcattgtttctctattaaattattttctct

SEQ ID NO: 12978 - DNA, 633 bp, Homo sapiens
gtctctcttcgtgggtcctgctcctcagctagcgccctgcaattcctgcatgaacggaatatctctcacctggatctgaagccacagaacattctactgagctccttggagaagccccacctaaaactggcagactttggtttcgcacaacacatgtccccgtgggatgagaacactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcattatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggagctgagtgtaaagagtatcattcattgtttctctattaaattattttctct

SEQ ID NO: 12979 - DNA, 641 bp, Homo sapiens
ttagtaaagctgacaaaaggatcttagaggtcatttagcccaagctcaactgcagattaaacacactgcataggaccacagaatcagctggttctgaacagtatccagaccttatgagtcttagacctatgttcttttccattgcacacttactagtatgatgctaggttcctatcttctactcttttccttttgttttcatctctccatactattatatggaaatttgaaaattagaatatttatgtcagttgagggggattacccctgtaatcctaccagtttggtaggccaagttgggaggactgcttgagcccagtagttccaagaccaggctgggcaaaagagtaagaccctatctcccaaaacaaaatgttagcgaggtgaggtggtgcgtgcctgtagtcccagctacttgggaggctgaggcaggaggactgtttgagccccagccaggagttgggggctacagtgagctatgatcacgccactgcactccagccagggcaacagagcgacaccttatctcaaaaaaataaaggaaattagaatatttagagcagttactatctgtctttctgtagttaaatcctagcaaggaatgggaaaaacaataaatcccagagaaaaatcaagaaaaa

SEQ ID NO: 12980 - DNA, 2081 bp, Homo sapiens
  misc_feature (481)..(481): n is a, c, g, or t
tttaggctaggtacgaggctggtttgaattggccgaggcctgcctgagtcgcgagccccagacatgagcccccagcgcatctccaaccagctgcacgggaccattgccgtggtgcggcctgggtcccaggcttgccctgccgaccgaggccccgccaatgggacgcccccaccactgcccgccaggagcagcccacccagcccagcgtatgagcgtggcctctccctggacagcttcctgcgggcctcccggccctccgccatgacccatgaggccccgaagctctccccgaaggtggaccggctctgcctcctaaaccgccccctgtccctgcaccttcagagcccccacagcagccccctggcccctgctgcagcccccagcgacccccggctccaggacctgaaggccagagaagcagaggcctgggaggagcccacagaactgctggggctgcccagtgccctggcgggcatgcagnaccttcgcctggagggggcactgcacctgctcctggcccagcagcagctgcgggctagggccagggcaggcagtgtcaggccaaggggccagcccacacccggggagatgctgccctccctaccagtcggctcagactctgagggccctgagaatgaggggaccagggcagctctggccgcagcaggcctgtctggagggcggcacacacagcctgcaggcccgggccgcgcccagaggacagaggctgcagccacgcaggactgtgccctagacaagcccctggacctctcggagtggggccgggcccggggccaggacactcccaagccggccggccagcatgggtcactcagccctgccgctgcccacactgccagccccgagccacccacccagtccggacccctgactcgcagtccccaggcactcagcaatggcaccaaggggaccagagtgccagagcaggaggaggcttccactcccatggacccctcacgcccacttccagggtcccagctcagcctgtcctctccaggcagtacagaagatgaagacacagggaggcctctgccacctccccacccacagccgcctccccacccacagccgcctgacctggacggccacccagagcccagcaaggctgaagtgctgagaccagagtccgacgaactggatgagacagacaccccaggcagcgaggtgggcctgagctcccaggcggaggccactacgagcacgaccggggaggggcctgagtgcatctgcacccaggagcacgggcagggtccaccacggaagaggaagcgggcctcggagcctggggacaaagcctccaaaaagccatccagagggagaaggaaactgacagccactgaggggcccgggagcccaagggacgccgaggaccacagtccctcccccaacagcagcccctgggaggagacctagccagcctgcaccagggtccacagcgagcccggggcagccctccacctgcccaccagggcctggagagggcacaccatccaaccagcaggcagccctgcacagaaccctgggagaagacctagccagcctcagctgaacccacagtgagcccagggcagctctctgcctgctcaccacagcctggagagggcacaccacccaaccagcaggcaaccccgaagagccggtgacgggcacatcctggcccacttcaagaggggctggaggaccgagaggggtctcaggctggcgattcaccccgtctccacccacctgggaaatgctctgcggcccctcccacagcccagcacctgctccctgaggggtgtggggactggaggcgggatcactcaggctccagcccagccctacccctgctgtgcactgcagccgttcccaggcagtgcccacgctctgggaggcaacggaccactcggacccccacccctgcccgccaagctccaagcacaatcttggacgccccctcgtgggctgacagcaaacagatgtctggcagtgagggtggagggagacagtgggcggcagcaccctcgaagaccgggtcccctgagtgacggagaataaacacttgaagaacaaaaaatgtg

SEQ ID NO: 12981 - DNA, 826 bp, Homo sapiens
agtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgtacatgaaaacaa

SEQ ID NO: 12982 - DNA, 212 bp, Homo sapiens
tcttgtgtttctgccaccaccatgagaacaccacactctaggatagctattgacccattagcctgagtctcagaaagaagtatctggaacagacccaaaccatttctgcagcttacagccagcccagccaaagtccaattgacccataagcctgtgagtaagaaaaacaaatgtctgctgttataaaccatagagattttttaggttgtttg

SEQ ID NO: 12983 - DNA, 369 bp, Homo sapiens
gccccagccagtgagacttgaaccccacctgtgactccagagccttcagatttaaccccctccccatgaactgccttccctcgccaggtggagaaagcctgtcaccaggccatttttggggaagtggtggggcttgcagatgagagggctccctgggctggagaggaccagctggcccctctaagctggcttcctcagctgcttcatggggcgaagggatgccaaggtcagcacagctacctccctctcccgcctgccctggggacctggcagtccccagtccctctctcctgctggaactgtgacctcccacaggcttcagatggcacgaaacccgggcatggtcagcacacgagctggccagccaca

SEQ ID NO: 12984 - DNA, 455 bp, Homo sapiens
ctcagttacctccttttaaggtgtccctagggtgagagagatgatcacgatagtcccttccacctgggcggcccaggctttcctcgcccatttagtgcctttcatgtagaatttccacctgttgtctgctgtgctgccactgcttgtcctccctccctgccacacagagctgtgttctctgcctgccactcacgcctacttctctgatcagggtttgtggaaccctccagcgtggtcaccattctggtacctgtggtaacacgctcagccttggtgtggcacattctaggtctaccgtttgtattcaccagcctgtgagcttgtgtacatgggacatgtatcttcgttttgggggctttctccttccacttgatgcccatcccttgagcgtttactacttgtggagcgcttggctttcaggccgtagagagctttccaatcagtggtgtccaggt

SEQ ID NO: 12985 - DNA, 554 bp, Homo sapiens
taggaaggcctgaaaagaatgctgaaaacaagtgacctggctggaatctaccaccacgctacttctctgctccaggaccttccatggctcccactggctcacaggcaaaagaagagatgaagcacacattgcaaacacgctttgatccctgcagtgagatgagcgtcatgatcatgcatgcttctcttctcccttctccgggccttttgaagtctacactctccgctgtgggatggtctcctgccctaccaggagagctggtctccacaccgacttcaaagacagctgatgttccagagaagaaaaacactgcaaagaagcactccaaaatccttttgacctcaaacatgactacagaatggatacagctttttaaatagccacttcctgcagcattctatagtataatgacccttaaatgacacccacgcaaattacataatttgctaaaatggaaacccagtaattccatcttacatcaaagtaaagaaaaaaaataccaaactttaaaaatctgaagctcaattaaatagtaattaaaaacgaaatataac

SEQ ID NO: 12986 - DNA, 1268 bp, Homo sapiens
cccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagacaaacatccttctgtgagtcattaaaatctatgaaccactctaa

SEQ ID NO: 12987 - DNA, 486 bp, Homo sapiens
ccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcaggtaaactgaggaaggagacggaaagggatgttctttcacttcagcctcccaagtagctggaattacaggcgcccgccaccatgcctggataattttttgtacttttagtagagacgagatttcaccattttggccaggctggtatcaacctcctgacttctagtgatctgcctgcctcagtctcccaaagtgctgggattataggcatgagccaccgcacctttaaattttttgtagagacaggatcttgctatgttgcccagtctggtctcaaactactggcctcaaatgatcctcctatcttggtctcccaaagtgctggggttacaggcatgagccatca

SEQ ID NO: 12988 - DNA, 509 bp, Homo sapiens
gcatggaaagtctttatttgagccccttagctgatgtggaatcagaagagcaaaaaggtcatcttcagagtggcctgggctgggtccttttctctccaggatagaaaagtggtggtcactttatccctagtagacatgctgctgggctttatcgccccagcattcccatcccctccagagccccttgtcactccagaccagcgagtgtgggcctttatctggactctgcttcctccctggggacaccaggtcttggagcaagagaacttggcaggctctccccatggcagtcttattcctcctcctgttcctatgtggaactccccaggctgcaggtaaggggcaagaggtacgggattccttagctatttgcaaggttggggagggactactgctctttctcctaggagcctggcgaaggcatctgactcaagaagatagaattaccccaaccaacctcctcctgcctctgacactagggaagacccagaggcaacgagggtccaggt

SEQ ID NO: 12989 - DNA, 606 bp, Homo sapiens
ttttttttggacacttggttttctcttatcctaggagactatgtgtgattgctctggctttaggaagcagaagctctgtgtcttgagcacagccgtctggggcagttgaaaccagttgggagattcccctggttccagacgttgttcatttggggtcctgtgtttccgactccacgggagtcactaatagtgtgacatctcttcatcacggcacccagaggatacagacctccccttaggaagggcatgtcactgttgacaggggagcaccacagttctggcctgctctaggaggtgaggctggctgcccactcagtgtcctgcctggtgacggaggcgtctggccctgtcctggtcactcctggtcactgctggtcagcttctcctcttgccttcatcgtgcagcaaagacagcggttgatcagaagcacagattctgaacaaagtcttcccttccaaagaatgaataaaggaggcttagttacaagctctaaattagagacaaatttgaaattagcttcattctcaataaaaaacaaagctgaagggtggaatgagcttggagttaaagccacttactgttgctaaaggctttaattcgagtgt

SEQ ID NO: 12990 - DNA, 772 bp, Homo sapiens
cactattacagttcccatccccacataaattcagtggaactaccctgtccttggtgcaaactgtggctggagaaaatcacacatccaccctgtctacaatagaaatgagaaatagatggagaaataaagagtccttgtgtgtggctttgcatctgcagttttggttcttgaggttctacctagttcctgcctctcctgctttgactctatgagctcccgctgtgcactttctgtgagccaatatatttccacttgcttagctaaattgaattgggtttctattaaaacaatcttgactaatatgccccttccatccaagactggttttgtatcccttctttgtgccttcagtaacacccagtgtttaccactgtatctttgaaaagagtgatgtctaatttatctatgattactttagcagtgttcacactgaattattgttatccatttatctgtgtctatcactaaactgtaatcatcctgagagttgggacttcattcttggatataatagtttctcagtctatgtgagatgaatgaatgaatgatcaaatggacaaatgaaatgtgatctaagatcatgggctttggtatcaaaaagatctagatttgaattctcgctctatcacttattctctgggtggcataatttgcttaacctctctcaaccttggtgtctttgttacctgtaattgataaaatgtggataataatgcctacccttcaagaatatcattagaattaagtgagagatgtacaaataaatgcccac

SEQ ID NO: 12991 - DNA, 626 bp, Homo sapiens
gactactcaagtgccatccttgggagaactgagaaagcagccactcgaatcattttctgtgttctgggatttagaggaggaacactggttgagaaagggaatatttttaaggctcttgacacatattgcagatggcttttaaaaataattccttgagtaagtacttcagtaccaagcatttgattctttgtaattcttggtagtatggttattattgtgaaaaatataggttatttctatcatctgaagtgtttcttcttggagggtgggatgtggctagaatacagtatgattgtgaagtaataagactaattttgacatgtggtttgtggaattggtttcattacttatagtcacatttgaggctttacaatatttctcacagtatctactacactgccttgaatgtagttcaatgcatgttctctgaaggaatttgtacatccaacctgtagagtaaaaaggaataagagaacacttcgtaggaccctaaaatgaatttttatattcaatttgtacagaagaatggtgaaagaatggagaaaaaatgaaactgagagaccctaactgtcccatttccatctctcacacttataataaaattcctctttgagtcaattcaggct

SEQ ID NO: 12992 - DNA, 339 bp, Homo sapiens
caggcatactttgattctaactttgcttgctagatggcgctcggtgtctcaggactttctgtttcagaattaaagcggctttttagcaccgttgttctgaactatttgtgggcatttgatcagtacagtgctggtaatgttattattgcccttgttttcgtcacactttttctctttttgattaaggtatcgtccaggtgggagctgcccatcttaatccatataataatgaaattcagggaaactctgcacctaaatttagggcacatgtgtggttcaattacctgttctggtgcacttaaaaaggcaccttagtaactttcctccaagaatgtgatt

SEQ ID NO: 12993 - DNA, 422 bp, Homo sapiens
ctggtggaatcaattaggaaagttaagcaggggagctcatcagcggctgattggccctctccctagaacaacccccagctcgcaaatactctcccagaatcattcaggggagcagtggggtctgtagaactgggccctgctgcagtattaagctgggaaggtagtaaattcttcttatgggcttccttgaatctgagctaaagccacaatttccttaatagttttccaatagcactccatctcttattaaaaagtacagttaatctggaccttccctcccactcccctgtaatgtcagaaaagaaatgtgtttctgaaaataaatgcttcttttgctgcgtggctatatttcttcaggactgtggttagcaaattgctgctgcacaacataaaaccaagcaaaacaaacataagacatatgc

SEQ ID NO: 12994 - DNA, 225 bp, Homo sapiens
agctagctaagacagaaaaggtaaataagttctagagtctcataatgcctaaaatgtcctggttcatttagaaatcatttggtatacaaagaaccaggaaaaatctcaacttgaatgtaaaaggtaattagaagattccagaacaaaaatgacaaagatgttggaattattcagaaaatattttaaagcagtcatcataaaaatgcttccagtatattgcttaca

SEQ ID NO: 12995 - DNA, 457 bp, Homo sapiens
ggatatgcagtttacacctgataagaatagtaagagaaacttgtcatattttgttatagttgaatattttcttttaatagattctacccttctgaaaggtggagtgtgtatcctattatttgttctcaaatttacctgtgatgtttcccaccttgaagccatgcctcctttcttctttttttttaaattttttattttacttattattattattattattattattattatttattattattttgagacagagtctcattctgttgccgaggctggagtgcagtggtgtgatttcagctcactacaacctctgcctcctgggctcaagtgatcttcctgcctcatcctcctgaagaactgggactgcaggcctgtgacaccaagcccagctaattttttgtattttttgtagagacggggtttcgctatgttgcccaggctggtcttgaacacctgg

SEQ ID NO: 12996 - DNA, 1481 bp, Homo sapiens
ggttttgctgagggctgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaagagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagattttttttgtgtgtgtggaaataaatctgcaattggaaacaaaaaaaaaat

SEQ ID NO: 12997 - DNA, 900 bp, Homo sapiens
ggttttgctgagggctgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaagatgtcatatctaggaagccattgccaaaatccaagctcatgaagatttacccgtttgtttccttctaagagttatataaactataaagtttctgttttatgtaaatccttttcatgttaattgtttaatacagtgtaaggtgggggcacaatttcattattttgcatgtagatatcta

SEQ ID NO: 12998 - DNA, 803 bp, Homo sapiens
ggttttgctgagggctgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatggtgagtagaacaagccacttgcacactcaggtgtagacgtggctccaagctcagcccgctgaaaggacctggagtttcccctttactgtaggaaaagttatcgacctgggttgttaatgcagtgtacctaatacagtatcattaacagacgtttggcatactggtgatacacatctatataccttgttaaaattctgggtggtgaatttccactttcccctttccaatctctctttgtgtgcgagcgcgccatatatatggtagacatacatatatattgtatatacaatgactaatatcattgtatatgttcaaggcttgtgggctgagactcagctatttgaagtcatccttccctaaatgggctcacttttacgcagtgactttgctgtacacccctcactctctcaaaatgagaataaattttatcagctttcaaaacgactcctccaccaaaaaactacttgaaaataaaatggaactacttaatatttgtttttattaataaagaaataaaatatctaaa

SEQ ID NO: 12999 - DNA, 1354 bp, Homo sapiens
ggttttgctgagggctgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatggacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaagagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagattttttttgtgtgtgtggaaataaatctgcaattggaaacaaaaaaaaaat

SEQ ID NO: 13000 - DNA, 384 bp, Homo sapiens
aaactgcctgccacccagtcttaggctcagtaaaaatgctcattagaagaattttcttaggataattccttagaatctggaagctactgcaaatattttaggtttggcatagaactgaaatcaacagaacatttaaaaattgattggagccttctggatttacctctgacatgtaacaagcttagaagtcattatgcccttcctaataataagaaaaacctgaacaaactaaaaacaatatctttattggacctgtcaggggactatggtcacaggggaaaatcaccaccctgaaatctgggaaagacaggtggaataggagtcacagctggagattggcttgctctggacccatgtttttttattgtctattctgattatttg

SEQ ID NO: 13001 - DNA, 420 bp, Homo sapiens
gcagatcctttttagctagatgcaaaaaactacttcactttgcacttcctgctccaaccctctgaacctgtctcctttctgaaggcccagttaccattctccatgacacagaccaacctgatcctattccacaataggaaatttcacatgtccttagaacttcaagttaataaatagtaacacagtatgctacatgactttgtataaagaaggagtactggccaagcgccgtggtccacacctgtaatcccagcgctttgggaggccaaggcaagtggatcactttaggtcaggagtttgagtgatagttaaatattatctgaatattaattctattgtatatcttttatttcattttgaaaatataaaggaatctaaaacttacttaaactgtaatttaaattattcattgttccctca

SEQ ID NO: 13002 - DNA, 420 bp, Homo sapiens
gaacatgtataatcagaaagaacatattcctaactaggaacattttcctttagatatactttgccaaaacattacttacttagacaatctgttacattgtgtgtaatcctcaactctgcagatggttgcacttccttaatattgcctgtctataattctaagaagtactacagtacacttcagggactgtatgtgctataaaaattgaaggtactttataaacaacttactttggagttctcccaaaggaagttattaaagtaattatggtattagaagtagcaggctattcctaaggtgaaatattaatgggattttctgtctacatattgtatgtttcctgtcattagcttctttcactatacaagacagataggtcccataagataagaactgaaaacatacgctggcaattaaaaa

SEQ ID NO: 13003 - DNA, 571 bp, Homo sapiens
tgtctgtcttctccctgttagaatgtaagctctatgacggaccttttctaacttgtttgccattgtgtccccaacttggagcctagctcatgcctgctacataatgggtgctcaataaatatttgttaaatgaatgaatcatacagcagctcaacttggattataatttagatactctaatttatattccagtacttatcatgctacctcaaacaaaaatggaggtaagaaaaaaaatactgatagccaagtcctcccctcactccaccaaaaaagaggggttgttgtatgtgtgtgtatacatttactcagttcaattccagcttaacaccattgggtattaactgtgtatatgatactgtactacaagttgggacttcagcataaattaaatgatacctgcctctaagatgaataaaaggacatgggcaaatacacaactagccacaagtcagctgttgtgttataagcaactgtgcttgaagtaaattagctaacgccaagacagatagcagcatagtcttagggatcccacttattaatggcatttattaagaccaaactcttccaa

SEQ ID NO: 13004 - DNA, 203 bp, Homo sapiens
agatgtatggaagtccttgtgtgaagagccctatgtggctttcaacaataaagtctcattgagttggaggcagtttggaaaaaggcttggagccccacattagatggataccagaagaccaacatcccattataaaaagaaagtccttacatcaaaatatttaaaccaaagggaaaggcccaagaagtatggaaaagaaacaa

SEQ ID NO: 13005 - DNA, 364 bp, Homo sapiens
aactaaggccagaaaagccaagtgcttggcccaaggaggcagggatgggactggcattagaaatcaggtatttgcagctgggtgtggtggctcacacctgtaatcccagcactttgggaggccaaggcgggtggatcatctgaggtcaggaattcgagaccagcctgaccaacatggtgaaaccctgtttctactaaaaatacaaaaaaaatagctgggcatggtggcacatgcctgtagtcccagctactcgggaggcagaggcaggagaattgcttgaacccggaaggcagaggttgcagtgagctgaggtcgcaccactgcactccagcctgggagacagagcgagactctgtctcaaaca

SEQ ID NO: 13006 - DNA, 581 bp, Homo sapiens
ttttttgcatctatgaagttttttcaaattctttttaagtgacaaaacttgtacatgtgtatcgcacaatatttctagtcgacagcactgctttacagaatgtaaaccgtgcactcccaggaaaatgcagacacagcacgcctctttgggaccgcggtttatactttcgaagtgctcggagcccttcctccagaccgttctcccacaccccgctccagggtctctcccggagttacaggcctcgctgtaggccccgggaacccaacgcggtgtcagagaagtggggtcccctacgagggaccaggagctccgggcgggcagcagctgcggaagagccgcgcgaggcttcccagaacccggccggggcgggaagacgcaggagtggggaggcggaaccgggaccccgcagagcccgggtccctgcgccccacaagccttggcttccctgctagggccgggcaaggccgggtgcagggcgcggctccagggaggaagctccggggcgagcccaagacgcctcccgggcggtcggggcccagcggcggcgttcgcagtggagccgggcaccgggcagcggccgc

SEQ ID NO: 13007 - DNA, 613 bp, Homo sapiens
cttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgt

SEQ ID NO: 13008 - DNA, 507 bp, Homo sapiens
ggagctctctggggtctctttcataagggcactaatccctcccagtggccccaactcctaatactatcaccttggaagtttggatttcaacatataattttttgggggagggacataaacattcagtttcattgtatatagtattgaataaaatatgccagccataaaaaatacatgctgtatagttccatttatatacagttcacaaaacaggcaatatcctaaactgtactgcttaggatataaaatataaagaaaaacaaggaaagggttaccataaatttcaggattattattagctctagtggtaaggaagggggatgactgaaggggacatcaatggcatttctggactgctaacagtattctacttcttgacatgagtggtgattacccagtttttcattttgtaataaataatttagctctacatcttgtgaatgtgtgtgactctatatgtgtgctatctttcatgatcaaatgttaaaatggcagaaccacaggaga

SEQ ID NO: 13009 - DNA, 314 bp, Homo sapiens
agggaatttggccctcgagcaagtaatttaggagagggaggtgcgcaccttctcctccctggagtggccttccaggtgccctctcagagctgctcatcagggctgtgcctttgtcagcaccaagcctcagcccttgtccctgctgccactgaaggctcaaaacaacactgcacagccttgtgtgtcctctgtgtgtcggcagtttcccccggctctgcagcagcccaggccaggtagcctctggagggagtggtggaggagcacgggcatcctggccgccgctgtgttggggacagaccctggggcctggaaag

SEQ ID NO: 13010 - DNA, 395 bp, Homo sapiens
aattggcatacatttaaaacatcccttaattcatattataagcggatgaatacttggagtccagttgcaggttcacctacaatctataaccttccatgtggctgggttaaccttctccctctgtctgcacctttcactcatttatccgtagaagcaattatcaggctgcagaaaatataaggcacacagagccttcgaaatacaacgtggtagggggattaatttggcaaatgacttttaaaaagtctgatgttgtaaaacagtgtgaggaggtaagtaggcagaggaacaagggcactctgtcgcttctgctcctgagcagaattttatccacacctctatgatagcagcctcacctcctactcacctcctaatgaaacaagtcgcgacacctt

SEQ ID NO: 13011 - DNA, 1596 bp, Homo sapiens
cctcacacgtataggtggtgaacttatgtgtaaatacatgtgtacagatgagaaactgcaacaaaaatgtcctgtggatgataatccagctcagtttccggttttctacattctgtgctgtttccagctaagaaaaaggcgaactcccactatataaagggaaaaggttgtattcatttcatgttcctcatgaaatctctgctgtatgtttatggaatggccatgactaaatgtatatatggtatgtaagaggccatgctgttaaatgttgcataaactaacacagattctgtagtcaaaaatatttaacttgttattgtaaaatgtgatttgtcattgagagattatttttctgtatgtatatgagagtattttaggaatctaatttaagtgcataaaactatagaaaaaaatttaaaacctattccaagagtagaaaatgcttaatgagattacttgggttcaactcaactaaatttcttatattaaaaaaaaattccaagttgtatatgttagaaatcaaatgagtcattttttttcctgcaggaaatatgataaatttcagtgtaatggatggtggcgtgatcaaatgaaaagtatcctgtagctatgacctcgcatgggaccttggtgttgcattaaaaatggatttttgcagatcacatatctgagagggtacttgtgtcaggaaggatgagaggatagggagcctgtttttcatcagatccatgtgccacgcaggcttccttgggttctagtggatttgttagggatctggggctgacgcagctatcccactagagaggccactctctgacttccaggtcgccctttctacttctgtatctggattgattcagtttatccctaattagcgtttgcgttttccatgaaatttcctgatgcatcctcactgtcttcaactgttgcatagccaggtgggtggatggatggtttagggtttctgagttaagccgttttggggcaggcttctggatgcccatgtttccatggagaccccagggggaagatgccttcctcccgtctgcattcccagaaaaggatcagaagtccaggctgcttctggggcacagactttctgtacttggccaccagaagtgccccttaggccacctaaggaggattctgtgaaactcaatgtctaaacccctgagaaaggcattcagaaatgatttcaggagggggcaaccccaggagtccagcctcccctggcagcctggaaatactgcagtaacaaaaagagctggtttctggtgatctgaatgcattgtgtttgggggtgacaccgctggtggaaggttgagggcctgtggtctgaaaagacatctgaagaatgtgttaggttttcaacatttctttgaacaggctgcgtgcatcttaatgctgtcaaccagcaactggagccccttttttgagaggcccgaaccagtaaagctgctgacttcaggagtatggggaagctgtgatttctggaagcttcctggaatctatttaggtgcatgaataatctgcaaatcacttagaggcactgtccatgtggtccataactggctttattcccaaagatggagctgt

SEQ ID NO: 13012 - DNA, 3474 bp, Homo sapiens
gcggcggcggcggcggcggccgggaagaactagaggtattccccgggcggctggaggactgagtcgagccgggacccgagtcctccggtatcccagcagccaccggaggcagtgaggtaatggaggaagaatgtagggagtcctccagtggaccacactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagacatcgggggaaagccgcgagaaggccagcgtccctggctgggagcagagctagccgagtagggcgcccggctgtcaaaactggccggcgcagtgcacgctgggccgccccggagcggtcgcagagcccgtcgggagtcgtagtccgggacgggcccgcagcattgtccgcgacgcagctcgggatccgcgtcgggttgtcggccgggttgctgccaggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaagtgcgcggggttcggtgccagccgctcgcccctggccgggccagcctcttgatgcaccggggacgggcgcgcccatccgactcttcgaggggcggcagggccccatctgtgtctttcgctctcgagcccccagctagagttggcttcagcggaatacctactgtgcaggattattcaacaagccgattgatcacattcttcagctctagcagtgcaaaggcttcactgaaaaagaacattacaaattttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctagagcaatgtctttcttgtattaaaatacggccccatgctcacatataggctgttttgtgttttgcttttctgttgatgcacaaaggaatccttgatatgtttgtcctcaaagaccaaagacaagtatctagtaaaaaatgcaaatcatatctaacagtgaagctttccagcaaaaaccttctgctctagaatgcataattatgcgagcataagatctactactctagacttttagcataattacctataggcagcaaaaccctagtcaattgagtgtctggtgcctcttggacctggacttctccaagagaatgggcaaggaggacgaaaaggaagagacagctatgctttgtgaaacaggaggtgacttaaaaaaaaaattctatagcagtcttcttaattcctgttacagacttgatacgcttatctgctgttgaggacacggttgccagtttctaaccttctctgtctgcctgaaaaactagaaattagatgatcatatggcctagagccagaagtgcaggaggcagaaagccaggggccagtttttttctttttgtttctgaataagaaggccaaatcctgacttaaaataatcaaaataaattttacggagtgacggtctttccagctgaaaaccttaaaacatggcatctggaagaaggccttagtctattgctcccaggatggtactatatagtcattaaatagcccacagataagggagttattgccccctcgttattgggctgccaggaattaaatgatggaactaagtttcacttgaaacattcccaaattaaaacaaaaacaagccttgctttgagctgttgaaaaggcattttactgagaagatccagatgctattgctgttcttaaatgatgttgaaaggcaaagggtcaggactttcaaaaagtcactttgaggtcacctcacataagcaagcaacagtttgaactgatgcaaaaacaaacaatgaaattatgaacaggaggaagaaactaaaatgagggcagtatatgccataaatatggaagaggctgtctcttatttatcttctcatttcctgtacataatacagaaacctggtatgtaataggcatacaattatttgtggctcaactgaataaacgaagatggaaaccagcaagcagcgggcagataatatacttgggaaaggagaactgcagagacgctgggtggttcaaggcttctgcatgatcctcaaatgtcaccccaatctgctgtgacatagctataccactcatcagaataccccaaaacaaattgtctgcctcccttatgtacaacttttattatttcttatctcggttggttaagaatatgtagtaatggccgggcgcggtggctcacgcctgtaatcccagcactttgggaggccgaggcaggaggatcacctgaggtcaggagttcgagaccagcctcaacatggagaaaccccgtctctactaaaaatacaaaattagccgggcgtggtggtgcatacctgtaattccagctactcgggaggctgaggcaggagaattgcttgaacctgggaggcagagtttgcggtgagctgagatcgcgccattgcactccatccagcctgggcaacaagagcgaaactccatctcaaaaaaaaaaaaaaaaaaaaaagaatatgtagtaatggttaagagtccactgtggaatcagcctgcataggtccaaatcccagccctgactgaatacctgtgaacaagttatatcagtgactcaggcttattatctgtaaaatggggattatagcattcctgcctcatagggatgttatgagatttaaataccaataagtctgtacattataaaccttatcagattggtgtggtgaaaatgctcagtaactgagcctcgtgagcattagaatgttgagatcagcatgaagttagcctgtatactgggcatacacattcttctggatttgctccttttgtgagcaatcaatgatgagctaaaggcatttgctaactagtaggaatgaaataaggtttcagacaggatcttggtgggtgatgtagattttatctgtcccatttgtcccatttctcaactggaagtgagtctggccttggtctgcatctgtgctctccccttcacaaaaggcaggcccagagagactccagagatggcccctgtctcctgtgtgtcctccgccgctgtgtccacttgggcacgtcaaaggtatgatcggtacttatctgatgaaaacaaatctttgtatatacagttgtctacctgggttgaatatttcagaggtataaagtagtttaaataaataaaccc

SEQ ID NO: 13013 - DNA, 422 bp, Homo sapiens
ttatacatacctcacattttggcattaaaataatagacattcctaggtaaatgtctagtctaagcatatgaaaaatcctgtaattcatgcttttaatcattcactatcaaaatggatattttctgcatactttgctgctgcatcagtcactgctggatgtataaagtgatgccccctgttctcagagggtttatagactagacgatcaagtatgttaggataatacttgagaaaaaaaggagactatacacagatgtgaattttgttgggccaataaaacattagagctattgactggagagaacaaaaagatggattattttttaaagaacaaagatggatttctttcttcccggaatctcccatgttacactgttacaatttctaaagagctatgtaagattacagtggtgagagagccc

SEQ ID NO: 13014 - DNA, 674 bp, Homo sapiens
tgctgggattacaggcatgagccaccattcccgacctgacatttacttttgaagctttcattcttaggagccatagtggaaatcattgcagttacacatagtgcaatcctctctagtcagaaatctgttttgccagattatctatgttttctaccgttgttttacagtcactcttgtcaccataacttgtctaatttgaatggctatccaaatagaaagttaaaagcaggttaaataatctgtttttttaagctttcttattttttctccttttcaaaaatagaaaatacacaactatatcagctgtgttgcaggggttgggggagggtagtgtgggacctcatgcatttaacagtgtctgctttttatgcttccaaagggggaaaaaatctctgtaggggctttaaattttcattttcttgtgcctttcccttatgaggaggtgcaggcccagccaatgttttatacattttgtcacaatgtattttctgttattctgagggtagaatcaggcgagaaaaataggaaaatgttatgttcatatggaagagttttgagcaactgggctaaattagtgaggaatttccttctagcttttaagtagaagaggcttgtccctatgaaagatgctgcccattcccttgcataactgaaaaaataaaaaaaaagttttg

SEQ ID NO: 13015 - DNA, 431 bp, Homo sapiens
gatggccttccctccagaagctacagtttctaggctgacttgtgaactttgtctcattgagagaactttgtctcattgagagaacttgtgaactttgtctcatgaacatccattaaacaaggataaagtccccagggtatgcagaattctgtccaataaagaagccaagatgtgcgaggcgcagtggctcacacctgcaatcccagcaatttgggaggctgaggcaggcagatcgctctgagctcaggagttcaagaccagcctgggcaacatggtgaaaccctatctccacaaaaaatgtaaaaattagccgggcattggtggcgtgctcctgtagtgccagctttggaaggctaggctggaaaattgcttgagcccaggaagcagaggttgcagtgagctgagatcacgccactgcactccagcctggg

SEQ ID NO: 13016 - DNA, 621 bp, Homo sapiens
aagtggattaaggacttaaatctaagacctcaaactgtgtaactattacaataaaacatttgggtaaatctggacatttatctgggcaaaaaattccttgagcagtactgtacaagtccaggcaaccaaagcagaaatggacaaatgggatcacatcaagttaaaaagcttctgcacagcaaaggaaacaatccacaaagtaaggagacaacctccagaaagacagaaaatatttgcaaattactcatctgacaagggattaataaccagaatatataagaagctcaaacaactctatagaaaaaaaactaataatccgatcacaatatgaccaaaagatttgaatagacctttctcaaaagaagacgtacacatgacaaacaaaggtgctataaacatcattggttatcagagaaatgtaagtcaaaactacaaagagaaatcatctcagttcagttaaaatggcttatgtccaaaagacaggcaagaacaaatgcgaggatgtggagaaaagggaactcttgtatactttaggtgggaatataaattagtacatctgctatgaagaacagtttggaagttcctcaaaaaactgaaaatagaaataccatattacctagc

SEQ ID NO: 13017 - DNA, 2701 bp, Homo sapiens
  misc_feature (153)..(153): n is a, c, g, or t
atgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgantccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacataaaaattttcta

SEQ ID NO: 13018 - DNA, 1871 bp, Homo sapiens
caaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacataaaaattttcta

SEQ ID NO: 13019 - DNA, 2914 bp, Homo sapiens
  misc_feature (153)..(153): n is a, c, g, or t
atgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgantccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtaccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacataaaaattttcta

SEQ ID NO: 13020 - DNA, 2079 bp, Homo sapiens
caaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacataaaaattttcta

SEQ ID NO: 13021 - DNA, 1747 bp, Homo sapiens
tgaaaggctttgctgactcccccaaccctcgcccaccagcttgtgcctctccgcagtcactagatgctgccttatctctaatatttaccttttcttcaacttatttttttaaagacgggaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacataaaaattttcta

SEQ ID NO: 13022 - DNA, 2508 bp, Homo sapiens
  misc_feature (153)..(153): n is a, c, g, or t
atgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgantccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacataaaaattttcta

SEQ ID NO: 13023 - DNA, 2292 bp, Homo sapiens
caaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtaccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacataaaaattttcta

SEQ ID NO: 13024 - DNA, 2738 bp, Homo sapiens
  misc_feature (153)..(153): n is a, c, g, or t
atgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgantccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacataaaaattttcta

SEQ ID NO: 13025 - DNA, 462 bp, Homo sapiens
tgggatctgtgtgatgtttttctcatgattagactgacatagcgtcttgggaggaagagcacatgggtaaagtatcgttttctttgtgtcacatcaaggttacatacatggcttatcagtgatgtgtagccttgaccacccctactgaggtagtattggtcaagtttctctctctttcttggggtgcaagcggggggacctttctatactgtactcttgagaaggaagtcagtatgtgctcccccatccccgtatgatgttatgaaatcagccaggttgatcgtaagcagatttttcaagtgtttcctaccctctaactcttgttaattccttgtagatgtttgttattattgtttaatcattgcttagcaccctatgagcagtctttaagagtatgggtagtggggagtgacagtatgtttttgccccaagcttcttggttgcaaacaaaacaatttgtcc

SEQ ID NO: 13026 - DNA, 629 bp, Homo sapiens
gtccttgggtcctggatcgttctgggattgtttgtatatttctgctcccaagggtgcctggggaagagccactgcgcatgttatctttggtgttactccagtgttgagcagagagctggtcagaggcagcgcatcgcagagagacattaataagggaatcctttgaatccctaagcagcagcagctttcctgagggggccgatgatgccagtgacctctcagggaagtctgggacattgggacccaccctgggggaggagcttgtgggatgtggcttttcttttcatgactaaagtactttgagttgtttgaaatcacctatctcagcatcaagatggttttctcccttttttaagtttttattttaactgaacattttagaaaaacaccccacggataaaaacttgactaaatggcagtgtaagtgccacaccttttgtcagtgttctgggagaaattgaccctcagagccgggtgcggtggctcacgcctgtaatcccagcactttgggaggctgaggcgggtggatcacaaggtcaggagttcaagaccagcctgaccaacatggtgaaaccccgtcttttacgaaacatacaaaaattagctgggcatggtagcgcatgcctgta

SEQ ID NO: 13027 - DNA, 368 bp, Homo sapiens
ggtcgacacgaagtatatttttgcataaaactaaggattttaaaattgtacggtgactttattggaaatgtgaccctttatgccaggaatcagtgagcttttcctataaatggcgagacagtaaacattttagactttgcaggctctaaggtctctgtcacaaccactcaactctgttattgtgtgaaagcactcatagattatatgtaaacaaatgagcatgttcatgttccagcaaacctttatttttttaaaaaaggatgataggcgggcaggcgcagtggctctagcctgtaatcctggcactttgggaggccgaggcaggcggacgacaaggtcaagagatagagaccatccttgctaatatg

SEQ ID NO: 13028 - DNA, 460 bp, Homo sapiens
cacacccatgcgtggggacctgcctggtgccggcagaggccacaggaggccagtgtggttggggcaccgtgaatgaggcagtgtttcccattctcaaatgagacagaggtctgggacatgacattgcagagataccagaggtcaagttatgaagggtcttacaggctactgtgaagactctgctgtttttcagcataggaaataggaaaccattgaaggattttgtgcagaggagtgccatgatctgagttaaattttctaaggatcaccctgatgggtcttttgaaaataggtttggaaggtggagagtcaagagcagaagcagggagaatagttaggaagcttataggtatcataggaaattattatgatagatatatgtaggctctttttatgacagaatcatgtagaaactaagtaattgatgatgactgattacattacttatggaaaatttaaa

SEQ ID NO: 13029 - DNA, 513 bp, Homo sapiens
  misc_feature (315)..(315): n is a, c, g, or t
  misc_feature (492)..(492): n is a, c, g, or t
ataacatttctttctacagatgtatagacatttatggaatgactatctttgaggaaatagatattacttacatagagttaatattttggatgttatgatcttgttggaattagaagctttcagtaatttacatccttaaatagatttctatcttctttttatttccaagatttttctcacaagtttattcccagtacagagacatcattatgttatagaggagcttttttgtgtgatagctcttggcagccagtttggtgctgacggtgagaggaaattagaatctgtttgcaaattgtccaacccaccccctcnacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaantaaagctgtttattaaccttg

SEQ ID NO: 13030 - DNA, 273 bp, Homo sapiens
agccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaa

SEQ ID NO: 13031 - DNA, 942 bp, Homo sapiens
ctgagcaagaccatttttatttacagcacggaaagcagcagaagcatcacatgatactgccagttcctctgccattacatcccacataacacaaagggcccaggtggcagctatgcgggcagttgtgctgcagctgaggaatctaggaccaagccctccataccttttacagcaagtaatgaacaagccagaatccttcccctgaggagttagtagtcatatggttgtctgtctgtgtcaccatgacctacttaattggctatgtgattagctacagaaatggctcagcatcataggacagctaggccttgcattttggcatactcagcaaggatgggtgcagatgctggggcccatggaagactgcctttcccaacagtgggtggtccatttcatccttatcacaatcctgagaagaagatgctactattatcccatttcacaagtgaagaaattgaggttcggtgaaagggaagtaacaaagcaacttgcttaaggtcataagcaacttgcccaaggtcaaaagtaacttgcccaatgttgcaaagctagtagacagtgagcagtgatttaaccctactctgtctgaatgcagggcccaaacaacatacaactgcctcattccatttggcaggaaattgagaaccacaaggaacagatttaaattatgtatctgagagaataattcattgtggttttttgtttgtttgtttttgttttgtttttgagatggagtcacactctgtcacccaggctggagtgcaatggcatggtctcggctcactgcaacctccacctcccaggttcaagtgattctccagcctcagcctcctgagtagctgggactacaggtgtgtgccaccacgcccggctaatttttatatttttagtagagacgaggtttcactatgttggccagactggtctcaaactcctgacctc

SEQ ID NO: 13032 - DNA, 1503 bp, Homo sapiens
tctttttccctgccaaaagagatctgacctcccttcttcatggaatatgtgcacttttcctcagacaaaaagcttaaacttttgtaagaggataaaaatttgagacagaatttaaagtcattaaggcttaattcatgtgtacccagatacctggaacctaccagatgataaggtgatgatgagcagagccttctagaggtctcatgtgaccctgaaacctggcaattcaggggattcatgcactccctgtgcatgagaaatgtcttctggtttctcctcatccattacgggagtgaaattttaacttggcttgtacacaggttgcttatttggctggtgggttcagatattggagtttcacctcaacagagactaaggaacagacctgtgagataaaagccagagagagaaaaaagagctaaagttaacaggtaacattgcccctacagtgggagcttagcctctagagagagagtgggcatcagattctctctgagaaatcttggttcttgatatgtgtgttatgtcaggaaggacttttacatttgggggttattgagcttaacttgaaattaatggcacatctcagattttgtttaagtttcctatttaccctcaatttttaatcttattaagagaaaggagccttagggcagaaccaaattctaactaactgcttaccagatcattagaatttcattctgaaggaaaattcttaaaaatgacacaccaccattttgagtattaacctcttgatataataagggaagtccttcttaaatttaattacctttctttttaaaattttttttttattaaaaaaaagaaaaaaaaaaccatcatctgaagacttacgtggagctggagaatctgctcccaatacaggttagtccatggctgtttgcaggatgcctcagttcttctactcatgagcctctccctagtgctgcttgagtgtccccataacttctggcttcctgaagagcaagtaattcaagagaaagctgggagcaagctaaaatgccatgacctattatcagaagtcaccatcatctatcaatcatattctattcattagaagcaagtcactaagtatagcccacactcaaggatgaaggaaattagtttccacctcctaaaaggaataccaaagaatttatggatatattttaaaaatagcacatgatctgaagttgaagagctcaaggtaattataggtcagggtctgcaagtaggaagggctgaaactagcatcacagctacttctttctattgaaaattttttacagtcctttgaagcggcgtatgaggagagcatccaggaactataatactgggattccatagcctccatttattaatccaagttcaatgagacccaatactaatatttagagaatgttatgagaagctataaaaacaggggagctggaataaatgatgtttaaagttccatccaactctttggattgtggaggttgctgatgacaattcttcagcctc

SEQ ID NO: 13033 - DNA, 836 bp, Homo sapiens
tctttttccctgccaaaagagatctgacctcccttcttcatggaatatgtgcacttttcctcagacaaaaagcttaaacttttgtaagaggataaaaatttgagacagaatttaaagtcattaaggcttaattcatgtgtacccagatacctggaacctaccagatgataaggtgatgatgagcagagccttctagaggtctcatgtgaccctgaaacctggcaattcaggggattcatgcactccctgtgcatgagaaatgtcttctggtttctcctcatccattacgggagtgaaattttaacttggcttgtacacaggttgcttatttggctggtgggttcagatattggagtttcacctcaacagagactaaggaacagacctgtgagataaaagccagagagagaaaaaagagctaaagttaacaggtaacattgcccctacagtgggagcttagcctctagagagagagtgggcatcagattctctctgagaaatcttggttcttgatatgtgtgttatgtcaggaaggacttttacatttgggggttattgagcttaacttgaaattaatggcacatctcagattttgtttaagtttcctatttaccctcaatttttaatcttattaagagaaaggagccttagggcagaaccaaattctaactaactgcttaccagatcattagaatttcattctgaaggaaaattcttaaaaatgacacaccaccattttgagtattaacctcttgatataataagggaagtccttcttaaaaagaaaggtaattaaatttaagaaggtcgacgcggccgcgaatttagtagtagta

SEQ ID NO: 13034 - DNA, 1449 bp, Homo sapiens
tctttttccctgccaaaagagatctgacctcccttcttcatggaatatgtgcacttttcctcagacaaaaagcttaaacttttgtaagaggataaaaatttgagacagaatttaaagtcattaaggcttaattcatgtgtacccagatacctggaacctaccagatgataaggtgatgatgagcagagccttctagaggtctcatgtgaccctgaaacctggcaattcaggggattcatgcactccctgtgcatgagaaatgtcttctggtttctcctcatccattacgggagtgaaattttaacttggcttgtacacaggttgcttatttggctggtgggttcagatattggagtttcacctcaacagagactaaggaacagacctgtgagataaaagccagagagagaaaaaagagctaaagttaacaggtaacattgcccctacagtgggagcttagcctctagagagagagtgggcatcagattctctctgagaaatcttggttcttgatatgtgtgttatgtcaggaaggacttttacatttgggggttattgagcttaacttgaaattaatggcacatctcagattttgtttaagtttcctatttaccctcaatttttaatcttattaagagaaaggagccttagggcagaaccaaattctaactaactgcttaccagatcattagaatttcattctgaaggaaaattcttaaaaatgacacaccaccattttgagtattaacctcttgatataataagggaagtccttcttaaatttaattacctttctttttaaaattttttttttattaaaaaaaagaaaaaaaaaaccatcatctgaagacttacgtggagctggagaatctgctcccaatacaggttagtccatggctgtttgcaggatgcctcagttcttctactcatgagcctctccctagtgctgcttgagtgtccccataacttctggcttcctgaagagcaagtaattcaagagaaagctgggagcaagctaaaatgccatgacctattatcagaagtcaccatcatctatcaatcatattctattcattagaagcaagtcactaagtatagcccacactcaaggatgaaggaaattagtttccacctcctaaaaggaataccaaagaatttatggatatattttatgcaagtaggaagggctgaaactagcatcacagctacttctttctattgaaaattttttacagtcctttgaagcggcgtatgaggagagcatccaggaactataatactgggattccatagcctccatttattaatccaagttcaatgagacccaatactaatatttagagaatgttatgagaagctataaaaacaggggagctggaataaatgatgtttaaagttccatccaactctttggattgtggaggttgctgatgacaattcttcagcctc

SEQ ID NO: 13035 - DNA, 179 bp, Homo sapiens
acaaacactgctttactagcccccgactatataatactgcactgatttagaaacagaaagcaagtcatagcctgcagtgagggaaagaaaagggaagcacttacccattgaggtggggtccacacctgactgtagctggcgtctccagcccagccagaggtcggtgtggaaagccccag

SEQ ID NO: 13036 - DNA, 124 bp, Homo sapiens
aaaagaaaggctttagttatgttctgcttggagcctattggcatggggggagctggaggcaggtgatctaggacaacttcttacatgattagtttagggatttctcaggtaggccctgagttgg

SEQ ID NO: 13037 - DNA, 910 bp, Homo sapiens
gcctggggcagacagcccacatggttaggaaaaagtgagtgaacgcatgtggcccccagaacccctccctgaaattgcagttgatttttattcccaccgtcaggcccacatatctaaagcttcctctgaacgctccttgcagtacacaaaatagaaatgattgacaggcacagagcagcagcaggccccacgctgtacaccagcatctggcactgtgggtcaccaagcaccaactcgatcccctcggagccaggtgtgtgttgagattcaggatttttcagttgcaaaggcaatatgatctctactccacagggcacacggcaccctcagtgctcagcacagcagtgtgcagcagcctggttaacttttctgcagggaagtatgtgaacgttcacaccaagcgtgtcagtcatgtctgtaagtcatctcccaccaacacaggtcaggttttcctgcccaatgagcttggggatggcttgactttggagctctttggatctgtggattttggaattttggatttctgatacccgtttgatcaaagaggcaaccgaggtctaacgggtcaagtgactttcccatatccgtgaaggtcatgaaaagcagggccaggatggtggcctggggtgccttgaatgataagctgggcccttcactgtgcaggcccctctccttcagtccactctgccactgctgtctgccacaccctgctctgatagctcctctctgccaggcttttccctcacatcctcaactcagccaagagctggtttcttccagagagccctgctgtgcagtcagttattggacttctctttttgtgcatgtttgttttcagggtttagctgatcaaagtggtatcgttgtaacaggcagctctaaatagaagtcttcagaagccaaagtgtgt

SEQ ID NO: 13038 - DNA, 520 bp, Homo sapiens
taataagaaactccctcactataaagaactcacagcctagtgagaaagtttgacaaagaaataacccgttgcagtgtagatgtataaaaagtgctgtggcaaacatcgttagaagatctgtgggaggtgcaccttggataggtcacagaaagcttcccagaagtgatgtccaagtggagcctgaaaaggcgagcattgtaattgactagggcttctgtctggagaatgaggtggtcggagatggatgtgggaaagaaagaggtgagtgaaggatttttcagccatcctaaggcaatggggagttagttggcaggttctaaagagagtgacacatcaggtttgtaattgagagaattttctctctgcaaaaaagaaaggggattgatagggaaaggaataacacgtgcatggctgcatgttctgaatggctgtcatagtaaccagaccagaaacaatggtgcttggactaaagtattaacgatgtcaaggaaaagtaggtgcacggttcttttgtttttta

SEQ ID NO: 13039 - DNA, 459 bp, Homo sapiens
  misc_feature (101)..(101): n is a, c, g, or t
cccctggtgttcccccaaaatcattgccaacaaaaaagcaaagcccattttacccctcctaagtaatgtcaagtaaaacaatgaaaggaaaaacctgaaanccttccctgccttaaagagcccattctgaggccctggccatgggttgtcacgccctgtaatctcaacactttgggaggcccaagacgggcgaatcacctgaggtcaggagtttgagactagcctggccaacatggtgaaaccccatctctactaaacatgcgaaaattaggtcccgggtgtgagccacggcacgcagtcataaaggcaatcctggggtgccatcaagaagagatgatgaggcgacagtgacacagcaatgactgccttcagttttatcatcagtcctggatagagaaggtgcaccactgcactctagcctgggcaacaagagtgaagctctgtttccaaaaaaaaaaa

SEQ ID NO: 13040 - DNA, 354 bp, Homo sapiens
ttttttgcctgagggcagaccccagtgagtactaagcagggcagctaaaatgcagatagatgcagtcttaccaaatagaagaataagagggaagcattcagggtaactatagcagctgtaaattgggatcaagggcaggaggatccaagaaaggataaaacaatggaaagggagcccaaaattttatgtataaaactctacctaagtctctggcaattctctgaactatgcatgtgtaagacagacgtcaagcagcccaactaaggccaaaacaactaaacagagatttcacttggtgtctgttttagtgagagatagagattgaatttagccatgttaattactggctaaaac

SEQ ID NO: 13041 - DNA, 361 bp, Homo sapiens
tgctgtatttacctcatgtacttattaaataaataaagtgtcatagaaatctaaaacaggctgggcatggtggcccacctgtagtctcagcactttgggaggccaaggcaggaggattgcttgagcccaggggttcaagaccagcctgggcaacagtggcacttcatctctactaaaaataagtttaaaaaaattagctgggcatagtggcatgtgcctataatcttagctactagggagactgaggtgggaggatcccttgagcccaggagtttgggggttgtaatgagttatgatctacgacactgcactccagcctgggtgacagagtaagaccttgtctcaaaagaagagaaagaat

SEQ ID NO: 13042 - DNA, 375 bp, Homo sapiens
aatccatgcattcataaaagaactcttggtcacctatagagggttctgggaaatgagctcattattttgagaactggtaaatacaaggaaaggatcaaatgtgaatcctacctttcctgtactaactgtaccacagagtaaccaaatagttgacaaaggaagtttctctattatgaagtattcttgctaatacatgattaaggaatgagaattcgagtatttgcacattcgaatgaaatagtggatttaggctaaatgtctaacatcacactaagagaaacaactgggcgcctgctaacaaaagtcctgtcactatcaccaatggtgtcttcttgcaaaaaattccaattataagtgatcaaattacctattagg

SEQ ID NO: 13043 - DNA, 470 bp, Homo sapiens
ccattaattctaaatcaaagcaattaatggtggcttatgcctatacagtcccagcttacttgggaggctgaggtgggaggatcacttgaggccaggagtttgagatcaccttgggcgatctcaacatagtgagaccctgtgtctaagaaaaattttttaaataaaataacgaactgggcatggtgatacacacctctactcccaggactttgggaggctgaggcaggaggctcactcggggccaagagttctggaccagcctgaacaacatagtgagacccctatttctacaaaacaatttttgaaaaaaattagggatgatggcacaggtctgtagtcccagctactaaggaggctgaagtgggaggattgcttgagcccaggaggttgaggctgtagtgaactgtgatggtgccactgcactccagcctgggtgacagggagagagcccatctctttaaaaaaaaaaa

SEQ ID NO: 13044 - DNA, 273 bp, Homo sapiens
ctattttttactattcacatcataactatatttttcctaaaataaatttattagaaaaatacttccttacatcaatactactcctgcttcccaatatagaatattactcaattacactcacaaagcaacagctccttttcaaggtagttcaattttttcagctttttagaacagttagtaaatatgacattatgagtaatactcctctaattttaaaatgaaaaattaggtgttataaattactaacctctttagttattttattaagttcag

SEQ ID NO: 13045 - DNA, 922 bp, Homo sapiens
ttgagggctcttaagattggtacatatacaagggctctgtttgaaagactttggctgccctggcgtcctggctgttttatgcctggtagctctagcggttaaaagctctctctgtcttgccactcctattacccattaccagtacatttgttggagaactttggttgtagaatataaatcccagaaacagagctgtgtgtgcatggttaagttttttagttcatgagagaagggggaaattaaagatcttgactcatacctggccagtacaacattgcacagggaagaaaaatgcaattaggtgcttgctttacagtagaagaaaatattggtaagtgttttacatcgggtcagattctggggattttctaattctgagccgaacttatgtactgtgaaggaaatggtgggtggttttcagaaaatagggaaacttttacatcaaaaactctgtaaagaagtcaaagataaatgtaatctgggaaaaaatattctgtaacattatatatagaaatcctttatgtataaatagcacctgacatcatttaggaaaagaactatttatgatgtagtatactgagaactgtgcacaatgtatggacaggtctagtaaatattagggaaaaagtaatgaaaaaacttgaaaccagcaccgctggtggaaggttatattggttcagctttgctggttggcttatcagaagcttaaattgtgcttttaatttgactgtgaggaacttatcctaataatagcaaaaacttggttaacagatactcttcagtagaaacaaattatagtttaactgttcaataaaatgctatgcagatgttaattttgagatctatatgttttgacatgataatatattaaatcaaataaaaattttataaaattgcatataaagatttgtactaggccggg

SEQ ID NO: 13046 - DNA, 399 bp, Homo sapiens
aatgctaaggacacactgtggctgacccctcttcatcgtgctgctgcctcccgaaacgagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgccctgcaccatgcagtgcatagtgggcatcttgagacggtgaacctgctcctcaacaagggagccagcctgaatgtctgtgacaaaaaggagcggcagcctctgcattgggcagcttttctagatcgatgaacccaatgcttttggaaacacagctttgcacatcgcctgcta

SEQ ID NO: 13047 - DNA, 250 bp, Homo sapiens
tgagccaatgtcaaccagccgaatgacaagggcttcacgccactgcatgtggctgcagtctcgaccaatggcgctctctgcttggagctactggttaataatggggctgacgtcaactaccagagcaaagaagggaaaagtcctctgcacatggctgcaatccatggccgtttcacacgctcccagatcctcatccagaatggcagcgagattgattgtgccgacaaatttgggaacacgccactgcatg

SEQ ID NO: 13048 - DNA, 726 bp, Homo sapiens
aatgctaaggacacactgtggctgacccctcttcatcgtgctgctgcctcccgaaacgagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgccctgcaccatgcagtgcatagtgggcatcttgaggtgaggactgttcccatccaggcccagctggggctttcccttttcttaccttcctactcacgtttccctgcttctgggccctcaagcctgaaggagaagcagcccggatggttatataaacacttaagctgaagcactaaatgaatggtcagactagattaaaattcttaacttggacttcaggaggttgataaaaccttggattttgcgtggaaaatatttgcatacacgcctttctgaagagagtccatgtctttcagcacatttgcaaagacttacaagagtttaagaaccggccgggcacggcggctcacgcctgtaatcccagcactttgggaggcgaaggcgggtggatcatgagatcaggagatcgagatcatcctggctaacatggtgaaaccctgtctctactaaaaatacaaaaaattagccgggtgtggtggcggccgcctgtagtcccagcta

SEQ ID NO: 13049 - DNA, 724 bp, Homo sapiens
aatgctaaggacacactgtggctgacccctcttcatcgtgctgctgcctcccgaaacgagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgccctgcaccatgcagtgcatagtgggcatcttgaggtgaggactgttcccatccaggcccagctggggctttcccttttcttaccttcctactcacgtttccctgcttctgggccctcaagcctgaaggagaagcagcccggatggttatataaacacttaagctgaagcactaaatgaatggtcagactagattaaaattcttaacttggacttcaggaggttgataaaaccttggattttgcgtggaaaatatttgcatacacgcctttctgaagagagtccatgtctttcagcacatttgcaaagacttacaggcgtgagccaccgtgcccagccacatctttttttctaacagaaaaacaaacaaaacaaacaaaaacaaaccttgagtaccatattcttagttctctgtttggctactggaaattctgcgctttgcccatcttgacctctaatagctaaaggaaatgtggttgagaaccactgatagaggaga

SEQ ID NO: 13050 - DNA, 378 bp, Homo sapiens
aatgctaaggacacactgtggctgacccctcttcatcgtgctgctgcctcccgaaacgagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgccctgcaccatgcagtgcatagtgggcatcttgagacggtgaacctgctcctcaacaagggagccagcctgaatgtctgtgacaaaaaggagcggcagcctctgcattgggcagcttttctaggacctccaagtgccctagttctagatcgc

SEQ ID NO: 13051 - DNA, 441 bp, Homo sapiens
atcgatgaacccaatgcttttggaaacacagctttgcacatcgcctgctacctgggccaggatgctgtggctattgagctggtgaatgcctgagccaatgtcaaccagccgaatgacaagggcttcacgccactgcatgtggctgcagtctcgaccaatggcgctctctgcttggagctactggttaataatggggctgacgtcaactaccaggtgcctgaagggataaggcttagaccagtggggagcgaaacttggatctaggggtcctgactgtatctggatagctctcttggggaattatccacttgcttcctagggtaatcagaccttgccagggactcaggaaagagtgggctaagaaggtgccatatgacccttttgtccttagagatatgtccttggaagggaggtagggcattctctgtgctttgcactgga

SEQ ID NO: 13052 - DNA, 237 bp, Homo sapiens
ctattcctccttccatttcctgttgttttacctcctgctcccactctctcttttgtcccctgcccctcaacagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcag

SEQ ID NO: 13053 - DNA, 546 bp, Homo sapiens
tatcatctaccaacagcccttgacttactaattgtagtttattgtgggtgaattaatctgaaatctttatagaatagctaaggctatagtaaatacatgtgaaaaatttaagaacaataacaccagcaatagagaagaaaatggagtgaaaagtgaagccactccatgttaacgtgtgtgttaacataaaactacccgtcaacaggtaactttactctgttgttcctaagtttttaatagtagctgtgtttttaaagtttatgaaccaaacttaaatgcattatgagagcttgataatgaaccagatcttagtaaaacagtattttaacatttggatatactagttgtactatgcttatctcagatccctgtaacactggtcaggctacaacttactaatgactacaaagaactatatacacaatcaggtttatttctgtctcttaaagcaaattgcaaataaaattggttactgcttttaaaaaggtgccaaacaccctaattctttgatttctgtttcacaattatagtaatatgtagagcaaa

SEQ ID NO: 13054 - DNA, 354 bp, Homo sapiens
tctgagtgcacagtcatgtcatttgcttattttatttcttcctttttcaatctttatggcttttcttttttgtcttattgcactggctaggaccactaatgcagtgttgcagaaaacgttcaaaattttattattaaataggatgtttgcagtaggtttttcttacttcccttctatttctaaattgctgagaatttgtatcataaatggatgcttattattgtattattaaattttttttgtctttcaagtaaacgtgatttttctctcttttgttgttttcatagtgaattatgttgacttttgcatgttaaaccactctggaataaaaaaacaatcagttgtgatgtattg

SEQ ID NO: 13055 - DNA, 484 bp, Homo sapiens
agccactattctccagatcccagaatggtagatcaaccaacagcttgcactgtacatctggaaaagctgcagacactcaatgccagcctatgaaagcagcttggaatggggctgtaccctgcaaaggcacaggggcagagctgcccaagaccatgagagtctacttcttccaccagtgtgacctgaatgtgagacatagagtcaaaggagattattttggagctgtaaaattcagtgaataccctgctggattctggacttgcatggggcttttagcccctttgttttgtccaattctcctatatggaatgggaacatcctcatccaatgcctgtaccctcattgtatcttagaagtaattaacttggttttgattttataggccatgctaatcagcattcagttctagattccaatttattctcagtgtgcctgtataacttttctttctatatatatataattaaatttctattacttattt

SEQ ID NO: 13056 - DNA, 290 bp, Homo sapiens
cccgatcatatattaaaacgcatacaaaggtacagtgaatttgatgatggcgcttaaatatagagaacagaatggtgagtcttggggaagagaggaagggttcagaaatcttccatcactccttaaaccaaaataaaatccgcatgcagaatatattaaaagatacacatctttttaagaaatatcacctatactcaaagaaaccttctggaagaatacattaaaaactaatattgccaaacaggacaatttgaaaagacgacgttaacaatgatgactacctgtgcatc

SEQ ID NO: 13057 - DNA, 416 bp, Homo sapiens
caccaaggtctacctggcctcccttctgtgactccagcctactctcttgccactccccacctgctaagcaatgccctggagatgtgtatacaggctcagaatatgctgcacgctctcctaccactgggacttcactggtgagttctcttgtcctaagacactttttcaagcactgctagcctggctaatgcctaggtctcaaacttaggtctccacttcttcaatgtcctttcctgatatcctcccctgcaactgacacgtgggttcagagcccttcctacgtgctccctaggaagacttggctgggaaagaggatttctaccttctgagtcagagcagagaccatttctgtttccttcatccctgttttccttagtatgcaaaagggtcctggcttgtcgtaagcacttggggat

SEQ ID NO: 13058 - DNA, 614 bp, Homo sapiens
ataaaacagaggatactacaggctgggaaagctgcagcaaagggagactagagagagatttgttaaaggatacaaagttacagcttggtaggaggaataatttctggtgttctataccactgtaggacgactatagttaagaacattatattccatttagtttcaaatagctaaaaggagattttgtccccaacaaaaagaaatgataaatatttgaaaccatggatactctaatttctctgatctgaccactataaattatatgtattgaaacattattatgtatctcccaaatatgttcaattcttatgtcgctcaaaaaataaaatttaatttaaaaagtatctgatttttaaagtaaatattttttaaagttttgacatttaaattacttgaatctcattattttgacaataatttaattcttttattgttcaatctgttagtgagatgtgtcataggtattatgtcattagttcaaattcttgtggaaattatagctacattaaaagtgtaacatttttatttagttgtgtacttatttgttaataatacagacattgtatgttatcatactgcaatttacaattaaaatattttctgtagattatttg

SEQ ID NO: 13059 - DNA, 284 bp, Homo sapiens
ctaccacacagatgcaccttgtgtaagccagtcatggaaagacaaatgttgtatgattccactgacatgaggttcctagagtagtgaaagtcctagaaggtagaatggtagttccagcggctgcaagaaggaggaaatgggaggttggtgtttaatgagtgcagagtttgggaagaggaaaaagttctggagacggatggtgcggttggcggcacaacataccagtgtacttattgtcactgaaaagtggtgaattttatgtatgtagtactttaccatagtaa

SEQ ID NO: 13060 - DNA, 466 bp, Homo sapiens
ctcctgcatagccttgttgggaaggaccaacaggtggcttgctggtgcctgagacacaagagactggtgagatgagctgaaaatgggaggtatttaacgggtgcttactctgtgtcatgtgcccttcttgctgctgaacaaagtggataaattccttgcctgaaagtaattaaggaagaggagaatggatactggagaaaatagtgatccatcacagcccactcctttggccctccatgtagccaggctcaccattttttctcagcagtggagcgtaatcaccacataccaacaacccaaagtcctgtctgggtgctgcatccatctccaagtccaggatctctgggtgatgtgctgtcctctccatcaagtgacagggtggctcttgcctcccacacctacatccagtatgtaatgatgttgtagaatggtatatctgcaataaaatctctctttcacaaatgga

SEQ ID NO: 13061 - DNA, 507 bp, Homo sapiens
actaaaaatacaaaaaaattagccaggcttggtggcaggcatctgtaatcccagctactcaggaggctgaggcatgagagtcatttgaacccaggaagtgggggttgcagtgagtcgagatcatgccactgcacaccagcctgggcgacagagcaagactctgtctcaaaaaaaaaaaaaaaagttttaagagactactgacatatatttggaaacattttgcctacatcttaaaataacaatcttaaaagtgtttcactgtctttgataagagacttgaaacccaccaatcgtagataagggatctttctacataactctatcatgcccacaagagaaaatcgaatatctcctactttgaaatttcccttttcccatttctatcttggccaaattacagtccgataaagaatatagtgagtttcatttcttgttgaacttgactgagaactagaaatgtaagatgacgatggaagtactgacttaatgccccaaaggaaagaaaaa

SEQ ID NO: 13062 - DNA, 386 bp, Homo sapiens
tccaagaagctcaaagaacacctgggatattcgttgcaaaaagattatcatctaggcacatagtcatcaggttacctaaagtcaaaatggggccggacatggtggcttatgcctataatcccagcactttgggaggctgagttaggcgattacttgagctcaggagttccagaccagcaacacagtgaaacactgtctctctaaaaaatacaaacagccaggcatagtagtgcatgcctgtaatcccagctacttgggaggctgaggtgagaggattgcttgggtctgggaggtggaagttgcagtgagctgagatcatgccactgcactccagcttgggtgacagagtgagatcctgtctcgacaaaaattaaaaaaataaagtc

SEQ ID NO: 13063 - DNA, 375 bp, Homo sapiens
gatttagacttaaaaaacataacagtatttattcatgtaataagtagacttttatttctgcaaagaatgaaaacatatagtatatactgttttataaggtaatttaaaatttaataatatattgtaatcatttctttatgccaataaatatggaactctggcgtcaatgtcttctcttccaccctccactataacttcattcttgttcagggagtatggtcctccaaatatttgaaaaagtaaattctgccgttggcccctttactctcttcctgtctttgttcagtaatgaaccatctagtactccatcttctcaaccaagcactggtgatgaggtttcatgcatttaggaaaagtgcatggattcttctgatg

SEQ ID NO: 13064 - DNA, 2023 bp, Homo sapiens
  misc_feature (1351)..(1351): n is a, c, g, or t
aggctggtcttgaactcctgacctcaaatgatccatccacctcggccccacaaagtgctggtcacatgcatgagtcactgcacctggccttgggttaggtttcacttcctccattagacatttgacattttattgtagcagctttctgggttaatatctctttgtgattgatagaagtggttggaagaggaagagtagggaaaagtgtgacattacagattaaacagtgaaaatcagtaccataatgactcctttacacccatgagatacgtaccatgatgaccagggctcggtgaaagaaagatttctttttttttttttgagatagtctcactttgttgcccagtctggagtgcagtggcgcaatctcggctcacggcaacctctgcctcccgggttcaagtgattctcctgtctcagcctcccaagtagctgggactacaggtgcatgccaccacacctggctaatttttgtatttttagtggagacagggagtcaccatgttggccaggctggtctcgatctcctgacctcaagtgatccagctgcctcagcctcccaaagtgctgagattacaggcgtgagccactgtgcccagccaaaagaacgatttcttagatggaggacctaggaaccaacagatgggctgctgtattactcttacccctttcattttcctgtatgcttcttcccaaggcagcatcaaattttgaattaatttttgctgcttaataaggacttaaactggtacccaagtcagaaagactctgcctctaattttctggggcttggggatgaagataaagtgttacacccagtgtttgtccaccacagtctgtggggcagagagacccttcctgggactgaattctcaatttgaagcactgttgttcaaagatctcccttctgggtctgacaagaagaaacataacccttatttattgcattcttctggcttacatacattgccctcactaatcaatggacatttcagcatttcattactaattttgagagaaggccaccatggaatttaataaaaatattattgaagagaattgccatcattctccattttccctgaactaccacaagcttctcagaattttagacaaatgtttttcccctcagaactgagcatcagtgctgctttggaaaaacattccatgtgaatactgtggtttcagtgtcaggacctgtacttgggcagttggaagagagtgtgccagttttttattgggagatgggaacaccaatttaattgatgcaattaggttgtaggttttttacagtttttcttttcttttctttttctttttcttttcttttcttttcttttttttttttttngagacataggctggctctgtcacctaggctggaatacaatggcacgatctcggcttactgcaacctccgcctcctaggttcaagcaattctgcctcggcctcccaaatagcagggattacaggcacctgccaccactcccagctaatttttgtgtatttttattagagatgaggtttcgccatgttggccaggctggtcttgaactcctgacctgaggtgatccacccgtctcggcctcccaaagtgctgggattataggcatgagccaccgcacccggccggttttctacagttttctaatactcaagatgttgactttgacaatacttatgtttgtatacttgtaatcttataatggggaaaatgtgtataaagatgttttaatatgtatgtagtttttcaataaatcttaatgccttgaagggaagatttgctgtccagcttgaatgctcattcttgggtcagtgcctgtctaaccttgaggagcatttcattttcaggttatctccatcccagggaaaccctctgggtctaaactgagaagctgctgcaattgtcccctcactggcttctcagtcctagtgaattgatcaagttaacttaccaagtggtttgggttcagctcaggtgaagaggataattgagtttacataaatggtaccttctattat

SEQ ID NO: 13065 - DNA, 771 bp, Homo sapiens
gagaaataagtgtcaactatggaagcagcaccacagaggggccatttttaatagtgcagggagcccaaggtcttcatggtggaggaggagctatctgagcttgggagggaacccgaggtaatggtttgggctaaaaggcatttctggtgtggcaaattgcaaaggacacaggcagaagtggagggctggggaacggtgacaggaggtgaggctggagaggaagggagagcagaggcctcagatcccagaggactgccatcctgggagagccctggcaggagttttcaggagtgtgacagagactgcatcttcgagaagaattaccctggaggtggattaggcctgaggctgctgtgggagtgttccatagcttcctctcctcttctttgtttcacaactcttgtaacttgctttgcaagaaggaatgtgatctcattgttcaattcccacctatgaaaaaaaaaaaaaaaaaaaaaagaaggaatgtgaaattgtggtgtttgttagtttaaagttgttttttattgataaatatcttgaaggactctcccaatgtgaaatccggttcaggatctgtctgcaaactcattgcttttcctggcttgaggtgcccacctctgcctttctcctcacagaccacttgtaattcaagataaacgaatgccagagagtaaaaatggataggcgcaggcagcatgatttagaatgaaagaatattaattggtttcaccggagcgtatattttcattatgagagaagtgactacctaga

SEQ ID NO: 13066 - DNA, 214 bp, Homo sapiens
taattatgaatgggtatggaattttgtcagacatgcgttttgtaccagttgatttgatcagttgatttttcttatttatattgctaaaattgtggattacattaatttttgaatattgaataagctgtgcattcccaaggtaaatcccacttaattctagtatactattatttttatatattactaaattcttaatccttgttgaggattttta

SEQ ID NO: 13067 - DNA, 434 bp, Homo sapiens
atgcacacacgatattctgtttcatccccggacagctctgtgaggtgagtaccaatattattcacatcttacgtaagaggacactgagtctcagagagaggcagagtcactgtccctggtgcacccagctagtaggggctggggtgggtgtgaaggggccagaagcttcccaataagtgcctgaagggcaaggctagggcatttgtagttcgaggctctaccactctgtctaggtcagacctaggaatgctgcaggtgttgcataaatgctcatcagtccaggctggaccgctcttgcccaactaagtgccaagcctggcctggctgatctcacagcctgcattctttgccctacacctgttgtgggaaaacgtaaatcctctcattcttagctaaccttgtgacccccgttctgggccagcaaagatgatccc

SEQ ID NO: 13068 - DNA, 376 bp, Homo sapiens
  misc_feature (5)..(5): n is a, c, g, or t
  misc_feature (29)..(29): n is a, c, g, or t
  misc_feature (38)..(38): n is a, c, g, or t
  misc_feature (69)..(69): n is a, c, g, or t
tagantacctgggcttgccttcctttccnctgtttaancctttttttttgggagatgggagtttccgcnccttgttgccccggggtggagtgcaacggcgcgatctcggccctggtgacagagcgagactctgtcttaaaaaaaaaaaaaagaaagaaaaaagaaaaaaaaaaaaccttcctaataccaaactaatccactttctatgtaaacactgatgttcagccaaggccatgctttatttttacggcacttacaacctaagacacgtagtttaccaaatatttggggatgtatagagaaagatcttcagtggaggctataaaagaacgatttattttagaagtacagaaaaatataaaaactgaagcaagaa

SEQ ID NO: 13069 - DNA, 273 bp, Homo sapiens
ctaatctccaattatccatagtcttgcaaggtattaaaaatgtcttttgtggccgggcgcagtggctcacacctgtaatcccaacactttgggaggccgaggcgggcggttcacgaggtcaggagatcgagaccatcctggctaacacggtgaaaccccgtctctactaaaaatacaaaaaaaattagccgggcgcggtggcgggcgcttgtagtcccagctactcgggaggctgaggcaggaaaatggcgtgaacccagcggggcggagctt

SEQ ID NO: 13070 - DNA, 180 bp, Homo sapiens
tgctcctcttggctggcagggggtcccttccagccctgtcctctctggcctttcctctgtgcacctgcacccctggggtctctctgcctctaaatgtcctcctcgtttatggaccccagtcagacaggattagggcccaccctaagggccatgagttaatttaatcaccactttagtgga

SEQ ID NO: 13071 - DNA, 263 bp, Homo sapiens
tttctatctttttataagggatttctatcctctgatgaaggaatgttttcagtagaaagcggttgctaaggaaaatcaatgaaaatgttatataccaaacaaactcggttcttgtttgcaaaaagagtaaaattatattagaaggagagaattagaagtaacttttctgagtgggaaagatttttcttgtaattatggtaaatttaggcaaagcttgtatatgctttccagaaacaatgagttcagaaggaggcttagaaatg

SEQ ID NO: 13072 - DNA, 720 bp, Homo sapiens
aaaatcttcccattggtttctgttaagagcatttttcattgaaaatataggcctttattgtctttaacattgaagtaactttgtagttttattcaattatgagccagcagatccttagtttaggcccttatattgcatacctaattagaactttccccaaagttcaactgcatgaccttaatgtattggagcacgtcttacaggtggacttaaaactctagaatttcctgagtcgttgttattttccactgaaggtctttccactgtacagcatttcaggcatcatcactatgactcttttttcttgactgttgcttgttttcccactgctcttttccccaatggcgagctgggtgtgccgtctctggggctctcttataggaactcacagtctagcctactgtattttgttttcggagaagtgaaagtgaacactgttatttgccatcatacctccatcaagaatttcacttcactaggaaatatatgggcctttcatggaactgatgattactgtggctgatgtgagtgttgggcttaggatgctcagcatgtggtagttggaagttttgtaatctaagatggaaatgagtgggccatttaaatggccatctaaaggtcacagtgactgtcagaagaagtaagaagagagtataattcttcagctcctggacttccataggaaagcttgaaatcttatacccagattaccaaaaaaaa

SEQ ID NO: 13073 - DNA, 362 bp, Homo sapiens
gaagaagagatctaaccttcttttagagattaaaaggctttcttttttcataaacaaactgcaaagtgttatgtggaatcaaaatacataaaacaggctgggcgcggtggctcacacctgtaattgcagcactttgggtggatcacctgaggtcaggagttcgagaccaggctgaccaatacggtgaaaccctgtctctcctaaaattacaaaaattacacaggcgtggtggcgtgcgcctgtagccccatctacttgggagactgagacaggagaattgcttgaacccgggagctggaggttgcagtgagctgagatcacggcactgcactccagcttggggaacagagcaagactctatc

SEQ ID NO: 13074 - DNA, 1530 bp, Homo sapiens
gttgatctagaggatccgacgctcgctctgtgggggccaggctggggccattggaatcagtatggtggtccccacctgcactccagctccgatggctgatgacgggggccctggcagctgaccccttgcctcagtggggagaccacggctcacgagggcatgagacctgcccagagcatagcccagaggccggcctggattctcacagctccgcccactgggctgtcctgccccaccccctttttagcctgctgggaccatgagtcagaacccagtaggtgtgaggggacccagccagcccaggtggccagtccagcctgagggggtgggggtctcagagattaagtcaggagcccagagtgcgtgcttagggtgcaacccaccccacagcctcccccaaggcacctcccgggggtgcagatgggggcagacgcagggacactcagggtggaccacctgactgggagctgatcatgaggtgtgcgacagcctgagtcagcctcagctcagaggagctgggatggccttgatcttccccctccggccactcaccacagctgggagggtccaaggagaccctcagccactgtcccttcagccctcaccccaccctggctggctctgcccggacagtccttagggacatcttggtcctgcccaccagccaggggacccagaattggagcaggggagcaggacccccagaccctctcataccgcttttgttctgaggccttgagggaacacggggtcttcgcgaccccaggcgagatgatgctgggacagaggagggtcgggctgcatcggggccctcctggtccccactcctgggtgagtcagcatctcagtctccagttctgggtgggcggcaccaggtgtgagcctcagcggtctccttgctggctaaggacctgggatttgctccagtgcccctcgggagggagtaggacacgtgcccagagagcaagcagaccccctccccgaccaacttctgagagcaaagacacctagagctagagattcagcaccccctgagcctcagtttctccactatgaagtgggatccgtgatctcagccttaccagggctgtgaggattaaatggtccagcccagcctggggcctgcctggagtaggcagcctgctcaggatgggctgtggaaggagggctggggtagacctttcaagtccacttgggcatggggagctgagagctagcatgccgtttaacttggcaggaagcaggccgggcgcagtggctcatgcctgtaatcccagcactttgggaggctgaggcgggcggatcacgaggtcaggagatcaacaccatcctggctaacacggtgaaaccccctgtctactaaaaatacaaaaaatcagccgggcgtagtggcgggcgcctgtagtcccagctactcgggaggctgaggcaggagaatggcgtgaacccaggaggcggagcttgcagtgagccgagatcgcgccactgcactccagcctgggggacagagtgagactccatctcaaaaaa

SEQ ID NO: 13075 - DNA, 896 bp, Homo sapiens
ggacccgaggccaggagccagggcccagaagaatgtggccccgtcccagagcaccacccgagacatcaggagcccatcgtgggctagggaagatcctccgggacctaacggcccaggtcttccacccttggccacctccccaggtgatgcctgaagctcaagggactgtgtccaccctcaggccctgcccgtggctctggatcggcggtccccatcagaggcctgggctgagtcctcaggggtcgacgcaggtcctctgggcagcatggggtggtgccgggtggaccccacggtggcctgtgttcgccacgtggccgtgggtcagttcctcgctggaggagacccttccccagacacctgccgggcacccagccaaacccttgaggcctgggaaggtctctggatgccaccctacaccccgcccagactcctctccctgtggttcctggacagaacattccgtcaccacgaaacgaagtttgcccaggccctgccttcaccctgggaaaacccagccgggcatgggaaggaggaatgctgcccgcctgcccgcccagaccagagtcgccccacatgccaggccaggcccgcatcctcctggggcacacgggagccccaggcttcccggcaggaaaagccccccaccgcagaagggctggtctctggtggggagttgctgctgggtggggtgaccacagggcggggttcaggctggggtatttttaatgatgtagttgcatctggtcaccgccccctgccacccccgattctttcctgccctccccaccttgtgacccagactgtggcttgaattaagaatgttttcagataagtacacgcctttgaggttaaaagtatgcctaatgattaaacaccagacagagatccccacagga

SEQ ID NO: 13076 - DNA, 365 bp, Homo sapiens
tgtggcctcccctgaagccatgtctcttcttgtcttcccgccactcttccagcaagctccccccgttggcccacctcatctgcccactgtgcacttggggcatggtgatctttgaccctggtggtgcacccctcaggctggacagggcctgaaggagccgtggttcattgcagggcgtctgagtggaagaggctcagcctcacctccacaccctgaagactcactctctggccctgggctctgttgtgtgcaccgcctgtctgcagggcccagcctgcctcgagcactccctggggacagaagctcctgcgctggcctctcctgtcacctagccaccgggcatcctggagtgcagccctcatgcc

SEQ ID NO: 13077 - DNA, 2435 bp, Homo sapiens
  misc_feature (897)..(897): n is a, c, g, or t
ttttctttcaactcgatgagaggaggactcctcctgggcctggtgcttcgaggtccagacgagcagacactggcgcctgtgaccctgcagcggacgcccttcaaagtccgcgtggccgcatttggaagcctgggcggcgtggagacggcgccttcagcttgagataaatgtggccccgtcccagagcaccacccgagacatcaggagcccatcgtgggctagggaagatcctccgggacctaacggcccaggtcttccacccttggccacctccccaggtgatgcctgaagctcaagggactgtgtccaccctcaggccctgcccgtggctctggatcggcggtccccatcagaggcctgggctgagtcctcaggtcaagaagtggcgctgacctggagcccctgcctggggctggccttcctcacagtgagctgggcctcctgccatcctggctctggagggcgtctgagtggaagaggctcagcctcacctccacaccctgaagactcactctctggccctgggctctgttgtgtgcaccgcctgtctgcagggcccagcctgcctcgagcactccctggggacagaagctcctgcgctggcctctcctgtcacctagccaccgggcatcctggagtgcagccctcatgccccgaggccacctgccatcgcccaggatgactcaagatgccacctgggtaagtctagcccagaacgagaaaggccgaatgagggaaactgagtcacatctgcttctcccaggtggggctgggggcccagggggagggcacttgtggtgacgaccagggtggactaggggcctgtctcccattctgtctctgccacacgttatagagcccgacctgtgggctgggtccccccatggtgagcactgnaggctctaggaggctgaagtcctggcctgggggacctgtgggggccaggctggggccattggaatcagtatggtggtccccacctgcactccagctccgatggctgatgacgggggccctggcagctgaccccttgcctcagtggggagaccacggctcacgagggcatgagacctgcccagagcatagcccagaggccggcctggattctcacagctccgcccactgggctgtcctgccccaccccctttttagcctgctgggaccatgagtcagaacccagtaggtgtgaggggacccagccagcccaggtggccagtccagcctgagggggtgggggtctcagagattaagtcaggagcccagagtgcgtgcttagggtgcaacccaccccacagcctcccccaaggcacctcccgggggtgcagatgggggcagacgcagggacactcagggtggaccacctgactgggagctgatcatgaggtgtgcgacagcctgagtcagcctcagctcagaggagctgggatggccttgatcttccccctccggccactcaccacagctgggagggtccaaggagaccctcagccactgtcccttcagccctcaccccaccctggctggctctgcccggacagtccttagggacatcttggtcctgcccaccagccaggggacccagaattggagcaggggagcaggacccccagaccctctcataccgcttttgttctgaggccttgagggaacacggggtcttcgcgaccccaggcgagatgatgctgggacagaggagggtcgggctgcatcggggccctcctggtccccactcctgggtgagtcagcatctcagtctccagttctgggtgggcggcaccaggtgtgagcctcagcggtctccttgctggctaaggacctgggatttgctccagtgcccctcgggagggagtaggacacgtgcccagagagcaagcagaccccctccccgaccaacttctgagagcaaagacacctagagctagagattcagcaccccctgagcctcagtttctccactatgaagtgggatccgtgatctcagccttaccagggctgtgaggattaaatggtccagcccagcctggggcctgcctggagtaggcagcctgctcaggatgggctgtggaaggagggctggggtagacctttcaagtccacttgggcatggggagctgagagctagcatgccgtttaacttggcaggaagcaggccgggcgcagtggctcatgcctgtaatcccagcactttgggaggctgaggcgggcggatcacgaggtcaggagatcaacaccatcctggctaacacggtgaaaccccctgtctactaaaaatacaaaaaatcagccgggcgtagtggcgggcgcctgtagtcccagctactcgggaggctgaggcaggagaatggcgtgaacccaggaggcggagcttgcagtgagccgagatcgcgccactgcactccagcctgggggacagagtgagactccatctcaaaaaa

SEQ ID NO: 13078 - DNA, 501 bp, Homo sapiens
agtccattctactcttccaaagtgttctattcttaacaaataattccaaggctcatctaattactacattggctcaaaaatccaggacatcttctgaatcaggcctagctgcagatgaggctcctcgggtgcagtttgttgggaacagattatcaagtacatttcctctacagtttaagacctgtgaactaaaaactcaagttatctatcagccacctcatcctctcatctccctcacattgtaaaatggtgcttgaggaataatgcaatagatagtcttactcaaaaaggagtggggtagagtaggaggcacatggtagtcaccatctgtagaaattctggtatctaccggtcatcactgccccagggtcaaaagatacactttgattaagatccagttttgctctgcctggctgtgattctgccctctgagtcatcctttctcttccataagaaatggcccatatgtgccttagggtagctttcttttttaaaaaaaaa

SEQ ID NO: 13079 - DNA, 533 bp, Homo sapiens
caaactgtttgcacgaggatggctgttcccatttcatacttttaaggaaaggattttggctggcagaaggcacttcccccctccagctggagggaagaagtatacagagatctagaacttgaaagtgcattgtgaacatggaacagcaaggggtttcgtgctgctgagaggtagtctgggtttagctgaagagggaacacaggtttgctcctcatttgttcagtcaagaagtattgaccgggcgcggtggcccacacctgtaatcccaacactgggaggcctaagtaggcagatcacttgagtccaggagttcgagaccagcctgggcaacatggcgaaaccccgtctctacaaaaaaaatgtaaaaaattagctgggcctggtggcacttatctgtagtcccagctactcaggaggctgagatgggaaggtcttgccttgagcctggaggcggagattgcagtgagccgagatcacgccactgccctccagcctgggtgacacctgggtgacagcaagatcctatctcaaaa

SEQ ID NO: 13080 - DNA, 422 bp, Homo sapiens
gtgaacatcctgtagcaaaggactgagcaaatgatgcggtggggcctgaacctgggcgttgtcagaggcgtgggaaggagtctgaagtctcattgatagtttcttgatgtcagtagttccgcaagttcccagaaaaaagaggaagccttcagtgaaactttttttaaaaaaaaattgattgattgacaaggtcttgctctgtcacccaggctacagtacagtggcacgatcatggctcactgcagccttgacctcctgggctcaagaaattctcctgctcccgcctcccaaatagctgtgactacaggcacacaccaccatgcctggctaatttttaaaatttttataaaaacagagtctcactgtgttgcccaggcttgtcttgaactcctggcctcaagagatcttcctgccttggcctc

SEQ ID NO: 13081 - DNA, 248 bp, Homo sapiens
cctcaacaggcccccagggttggctgtttcctgctttgtgcctgtcagaaggggaacgctgtgctcctaggaacctggaacagattctccctcacagtctcagaaggaatcaaccctgccaacaccttgatgttggactcccagcctccagaactggaagacatacatttctgttgttgaagcccctagtctgtggtactttattatggcagccctcccaaacaaatccagagatgaggcccaggacc

SEQ ID NO: 13082 - DNA, 557 bp, Homo sapiens
tcaattacatctttaaccatgaccatagttaacttttccatagttaattgcttaattatgatacattttctaaaagctcttgataaagaagtaaaatcctagaatggcgtatcttcaaggaggttcacagaaaggatgaaaagaaccctgacaagcactcttgaaaacaggtttctgataacttaaagatcacattatttggattaagaattcccaaaactctaatgaagagactgactgggttataaaacttctaacccaagcaagacaagaattaattgaataccaagaaaacactttgccagattttcatgctaaatcagctctcactaaaatgttttaagtatacaatttaaataaacttctatggtccaattcaaattacctatgatggcccacctaataaacagtgctatacatctgaattgaaaaacaaaattggtttttgagaggatctaaattcagtattaagcatatactcatggagagcctaaatggccacctggtccttccaaagtccttcaagctttcattgttaaaagttctgtatgccatca

SEQ ID NO: 13083 - DNA, 450 bp, Homo sapiens
aggcaggaatgtggagagaagaaagctacctgacaagggaatctcaggatacaaggaaaacaccaaggaatgtaaatctctgtttaccacaagccctctgtctccacaagttctgtgtccagaactgaaggcagatccaaatacaatattcatgggatgcaaattcccatgtatgccaagagataactgctttattggaggcctagtggggaactgaaactcccactcctgcttagcaggaatgagaagccccctttcagaggtcaacagaagctgagttaagaaacctgaacttttaccctacctggcagtaatgaagcgacacccaccttcgtctgtgaggatggtgtgagatgaaggtagctaaaacaaaaggtttaaataagattcagagtctcatcatattgaaatgtccatatttcagtggaaaattactcatcatacaaaaac

SEQ ID NO: 13084 - DNA, 925 bp, Homo sapiens
ttgagcatctccactggctgtgacaaaaccgctgtgctcacctttgacagagctctcctgaccaggtgggcaaagcctggaaggtcaagttccctggagaacgtcaagcttacttgacaagggtgtaaagtggggataaccgtggtatcttccgtgaaaactcaccctctcactctcatccatctcaggctctttatcactgcattgagatctgacagtctcatgtttgtctctgtctcattctctttctctctttcaccgtttctctgtctctgtatatttctctttgtctctgtgtctctgcctccctatctctcttccctgagccctcagcctgcccctctcattctccttggctggaaatgtatagacctatacaggcataaagaaaatgttcattcccactttgctgtgtctactttggggagacagctgtcaccctgagaatttcctaatcctaagaacttccattagcaaggtcaggttgccctttaggttgaggacaaggtgagtctatcccctatccccatagcttttcccaaatccctcaagcctcactttttctgagccttcacaacttttcatgctgctacagcggagtttggcccctgctagaaaagaaaggacctaatattcagttcaaagccagcaaaaacacctgtgttgagtgccctgctacttgagagggtaagggagatggaaggggagtacaaaagtgcaggctggaaaagagcttcagtgatcctggagagttagaggctgttgggtccatggcagggagcagaagtaaagcttgagtgacagctgtcattatacagaggcacacgaattcgctgccttaggccactgcctggtgggtctgagcagtttggagctttgggactagaggcacagttggactctaccctcaccccaaaggaaaaag

SEQ ID NO: 13085 - DNA, 327 bp, Homo sapiens
ggaattactagacagagactttaaaatatcttccatagtatgttcaaaagcaaaaggaaaaaatgaaccaaggactaaagaaaatcaggaaaacaatatacgaacaaaataagaataccaacaaagagacaggaattatgaaaaggaaccaagcagaaattctggagctggaaaacataatgactgaattcaaaaattcactggaaggattaagtcaatcttgacgcagaagaacaaaattagagaatttataatatcaggcttcaagacttattctaaagctacaacactcaagacagtgtgcaagtgtataaaactgaactagga

SEQ ID NO: 13086 - DNA, 810 bp, Homo sapiens
ctgcatccgcgccctgaatctgaaattggtcgtcctgccacgccgcctcaccgcggtataaggtcgtcccatcctgaatggccggtgcgcagactcaattgcgactttgaggctgtcagccgccacccggcaaccttccagtgaacaggattctgggtttctcaaagctgtaattggagggccactccagaggtgttaaagctccagcacttcgagcctgcctcgtgggaaagtcttaggctgagtctgtaggtgtctgcagttaagaagccagcggtctgcatatgattgctcaggggtggtggctgggtccaacagcattcactacaggcctgccttgaataccacctagcgcagtgctccgcatatcacaggggctggaaacctaacaatttcacttcctagacaacttgctaaaagtcacctaaagacagtctggttactgccaaagatatgctttcaaataagatttggataaagaagggaggtagatgccttttttcagcagtggagtgatgtctagaccagtagatgtacgcatctaagtgaattcatcaccagcaacaatttccagaaacttcctgacctccagattgcagcttcattagtgtgagtttaaagccaactagatgccattctcagattccacgcatatggccaagggtccaggaaataagaagaaacagggttgaggggttggtgttatggggcatttacttgaattttctatgctataattgtctcatctttaaaacggtgataataataaaattgtcagttattaaataaattaacacagtgaaaaaaaaa

SEQ ID NO: 13087 - DNA, 588 bp, Homo sapiens
agctttggattcataagctcagtaaattaaggaatttcacattatgaactcaatttgagatgggttggactggtgatacctggaaggggtaaatgagaacccactctggaggcactttacgcctgagggagcatccacaaataatttttcaggggctggaaacctaacaatttcacttcctagacaacttgctaaaagtcacctaaagacagtctggttactgccaaagatatgctttcaaataagatttggataaagaagggaggtagatgccttttttcagcagtggagtgatgtctagaccagtagatgtacgcatctaagtgaattcatcaccagcaacaatttccagaaacttcctgacctccagattgcagcttcattagtgtgagtttaaagccaactagatgccattctcagattccacgcatatggccaagggtccaggaaataagaagaaacagggttgaggggttggtgttatggggcatttacttgaattttctatgctataattgtctcatctttaaaacggtgataataataaaattgtcagttattaaataaattaacacagtgaaaaaaaaa

SEQ ID NO: 13088 - DNA, 547 bp, Homo sapiens
cccagacatcaaagctgagctttctttgtctccggcagcctgggccactccagaggtgttaaagctccagcacttcgagcctgcctcgtgggaaagtcttaggctgagtctgggctggaaacctaacaatttcacttcctagacaacttgctaaaagtcacctaaagacagtctggttactgccaaagatatgctttcaaataagatttggataaagaagggaggtagatgccttttttcagcagtggagtgatgtctagaccagtagatgtacgcatctaagtgaattcatcaccagcaacaatttccagaaacttcctgacctccagattgcagcttcattagtgtgagtttaaagccaactagatgccattctcagattccacgcatatggccaagggtccaggaaataagaagaaacagggttgaggggttggtgttatggggcatttacttgaattttctatgctataattgtctcatctttaaaacggtgataataataaaattgtcagttattaaataaattaacacagtgaaaaaaaaa

SEQ ID NO: 13089 - DNA, 319 bp, Homo sapiens
aattcctatatatgctatctgagaagacatttaatcaaattcatcattgattgaaaatgatcttaaaaatagaaataaacgggtatatctccagtaccaaaaagtacatcatggttagggaactagaagcattctcactaaagtcaagataatagtttaaagggtgctgacgccttgggccagctggttccactttcacacatactgtctttgttatataaaaacgtgtacagcacgagggaaggatagaaggctgttcatcccatgaaatgagatgaattatataccttgttacatgttatacaatgtgatattaaaa

SEQ ID NO: 13090 - DNA, 293 bp, Homo sapiens
gtggtgatgttggtataaacaaacctactgcactgctagtcatataaaagtatagcacacacagaaggtataggacataatactcaataatgataataaatgactatattactgatttatgtatttattttttattgctatttcagagcatagtcattctacttatatgttaactgtaaaacagcatcagacaagtccttcaggaggtatttcagaagaaggcattgttgtcctaggagatgagagctccatgcatgttatttaccctgaagaacttctagtcagacaaggtg

SEQ ID NO: 13091 - DNA, 2987 bp, Homo sapiens
cccctccctcccagtcagcctccgccgcagcccaggaagccagccgggacgccgccgccccggaccccgcgccctaacctccacctcgggggcctgcacccccagattgaatcgggaattccggaaacccgagcctggaaccctgatctgggaccagcaccccgagatccggccgtggaaccccaagatctggagcctgaaccccagtatatggggctggaatctcaacatcggtcactgggacctcaatatttggagccggaaccccacaatttggaacacagaccccaatatttggagcagaaccccaagatttgacatctaaaacctcaagcctggagctgaactctgaattctgggcctgggaccttgaaatctgggactggatttccagtactgtaccctggaacccactcttggggacctgaaccctgggattcaggcctcaaattccaagatctggactgtgggattccaaggggcctgaacccgagtttgggcctgaagtccttgctgcagacctgagtgcttaaatctggggcttgagacctcccaatcttgactcagcaccccaatatctgaatgcagaaccccgggatcggatctcagactctaaaccccaccgtttggctgcttagcatcccaagactggacctgggagaccctgaccctgaacaacccaaactggacccgtaaaactggaccctagaggcccaatatttaggggtctggaaccccgagtattaaggtctggagactccgttgccacagatttgagccgagtcaggacacagtccctctacagaagccttggggacaggaaaagcatgaccagatgctccctccagagccctgacctctgactcccctggagctaggactctgctccctggggctgcttctagctcaggacacccctgcccgcgatggccatcctcccgttgctcctgtgcctgctgccgctggcccctgcctcatccccaccccagtcagccacacccagcccatgtccccgccgctgccgctgccagacacagtcgctgcccctaagcgtgctgtgcccaggggcaggcctcctgttcgtgccaccctcgctggaccgccgggcagccgagctgcggctggcagacaacttcatcgcctccgtgcgccgccgcgacctggccaacatgacaggcctgctgcatctgagcctgtcgcggaacaccatccgccacgtggctgccggcgccttcgccgacctgcgggccctgcgtgccctgcacctggatggcaaccggctgacctcactgggcgagggccagctgcgcggcctggtcaacttgcgccacctcatcctcagcaacaaccagctggcagcgctggcggccggcgccctggatgattgtgccgagacactggaggacctcgacctctcctacaacaacctcgagcagctgccctgggaggccctgggccgcctgggcaacgtcaacacgttgggcctcgaccacaacctgctggcttctgtgcccgccggcgctttttcccgcctgcacaagctggcccggctggacatgacctccaaccgcctgaccacaatcccacccgacccactcttctcccgcctgcccctgctcgccaggccccggggctcgcccgcctctgccctggtgctggcctttggcgggaaccccctgcactgcaactgcgagctggtgtggctgcgtcgcctggcgcgggaggacgacctcgaggcctgcgcgtccccacctgctctgggcggccgctacttctgggcggtgggcgaggaggagtttgtctgcgagccgcccgtggtgactcaccgctcaccacctctggctgtgcccgcaggtcggccggctgccctgcgctgccgggcagtgggggacccagagccccgtgtgcgttgggtgtcaccccagggccggctgctaggcaactcaagccgtgcccgcgccttccccaatgggacgctggagctgctggtcaccgagccgggtgatggtggcatcttcacctgcattgcggccaatgcagctggcgaggccacagctgctgtggagctgactgtgggtcccccaccacctcctcagctagccaacagcaccagctgtgaccccccgcgggacggggatcctgatgctctcaccccaccctccgctgcctctgcttctgccaaggtggccgacactgggccccctaccgaccgtggcgtccaggtgactgagcacggggccacagctgctcttgtccagtggccggatcagcggcctatcccgggcatccgcatgtaccagatccagtacaacagctcggctgatgacatcctcgtctacaggatgatcccggcggagagccgctcgttcctgctgacggacctggcgtcaggccggacctacgatctgtgcgtgctcgccgtgtatgaggacagcgccacggggctcacggccacgcggcctgtgggctgcgcccgcttctccaccgaacctgcgctgcggccatgcggggcgccgcacgctcccttcctgggcggcacgatgatcatcgcgctgggcggcgtcatcgtagcctcggtactggtcttcatcttcgtgctgctaatgcgctacaaggtgcacggcggccagccccccggcaaggccaagattcccgcgcctgttagcagcgtttgctcccagaccaacggcgccctgggccccacgcccacgcccgccccgcccgccccggagcccgcggcgctcagggcccacaccgtggtccagctggactgcgagccctgggggcccggccacgaacctgtgggaccctagccaggcgcccccccctctaagggtcctctggccccacggacagcaggacccggacaccctgtgggacctggcctcaaactcaccaaatcgctcatggtttttaaaactctgatggggagggtgtcggggacaccggggcaaaacaagaaagtcctatttttccaagcttgggcg

SEQ ID NO: 13092 - DNA, 398 bp, Homo sapiens
acagctgctgtggagctgactgtgggtcccccaccacctcctcagctagccaacagcaccagctgtgaccccccgcgggacggggatcctgatgctctcaccccaccctccgctgcctctgcttctgccaaggtggccgacactgggccccctaccgaccgtggcgtccaggtgactgagcacggggccacagctgctcttgtccagtggccggatcagcggcctatcccgggcatccgcatgtaccagatccagtacaacagctcggctgatgacatcctcgtctacaggtgcagggtccaggcactggggtagcttgggtgggggagtgaggcaaggggagggttgagggtacacctactaataccctacaccgaagcacaactgataagtgatgc

SEQ ID NO: 13093 - DNA, 422 bp, Homo sapiens
tgctagataactgtttctttccatatgtcaaaaaagccagcctgcagatttttaaaattctccttacggtgactgatgttgtgcaaagttcttttaaagagtaccactgactggcccatgtcttttgctcatgttccctgtatggcttcatgtgagtacttctgaagaaagccactattattgatataaagcagttctttattcccaacccctaaccattggcacagtttatataatgtgggtcagaaccatttgtgattttctgttatgagggccagagtttgagattttaaaccattcattcaaagaaacttaagaaagacacagttaaacaccttagaaagatacattttcatctaactagcctaattacgagctcagctaaaaaaggtacaggatcctctagaagaatcgtgctgtat

SEQ ID NO: 13094 - DNA, 177 bp, Homo sapiens
tactactatacgggtgcttttagacgacagaagggtgccccgtctgacacccctggggttgctgagggaacggttggagtggggatcggcctgcgaaaggatactgtgaaatcactaattaactaataaacctgtctcaagttgaggatttgaagaagaacacagaagtcgcatcga

SEQ ID NO: 13095 - DNA, 142 bp, Homo sapiens
tactactatacgggtgcttttagacgacagaagggtgccccgtctgacacccctggggttgctgagggaacggttggagtggggatcggcctgcgaaaggatactgtgaaatcactaattaactaataaacctgtctcaagt

SEQ ID NO: 13096 - DNA, 649 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcgggaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgtaagtattgttttcagagctaatgaatttcacattttattttgaaacttgaagtctgtgtgtcccttttttttttttt

SEQ ID NO: 13097 - DNA, 1503 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgagtagctgggactacaggcatgtaccagccaccacgtccagctaatttttgttttgctttttttaagtagagatggggtttcaccatgttggccaggctgtcatctcctgtccccgcga

SEQ ID NO: 13098 - DNA, 1417 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgaggatttgaagaagaacacagaagtcgcatcga

SEQ ID NO: 13099 - DNA, 1838 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcgggaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgagtagctgggactacaggcatgtaccagccaccacgtccagctaatttttgttttgctttttttaagtagagatggggtttcaccatgttggccaggctgtcatctcctgtccccgcga

SEQ ID NO: 13100 - DNA, 1971 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcgggaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttggtaagctcagccactttcggtgagacccccgaggctttgggaagccacccttgggcaggacataagcaggacttatctccctgcagcgtctagggcagcaccgtccaatagaaatatgatgtgagccttacagtcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgagtagctgggactacaggcatgtaccagccaccacgtccagctaatttttgttttgctttttttaagtagagatggggtttcaccatgttggccaggctgtcatctcctgtccccgcga

SEQ ID NO: 13101 - DNA, 1476 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaagggcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgagtagctgggactacaggcatgtaccagccaccacgtccagctaatttttgttttgctttttttaagtagagatggggtttcaccatgttggccaggctgtcatctcctgtccccgcga

SEQ ID NO: 13102 - DNA, 1811 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcgggaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaagggcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgagtagctgggactacaggcatgtaccagccaccacgtccagctaatttttgttttgctttttttaagtagagatggggtttcaccatgttggccaggctgtcatctcctgtccccgcga

SEQ ID NO: 13103 - DNA, 1382 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagt

SEQ ID NO: 13104 - DNA, 1756 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcgggaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgagtagctgggactacaggcatgtaccagccaccacgtccagctaatttttgttttgctttttttaagtagagatggggtttcaccatgttggccaggctgtcatctcctgtccccgcga

SEQ ID NO: 13105 - DNA, 1538 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacaggtgacatgacatgagaattgccttaaaatactcaaggaaaaaaatcctactgctgggtgtgggaggtgcttgatgaaatgagatctgcaaattgttaatagtgattcctgagtgagcacatatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgaggatttgaagaagaacacagaagtcgcatcga

SEQ ID NO: 13106 - DNA, 1306 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggtttttaaggctggctggagaagacagtgggagggtgccccgtctgacacccctggggttgctgagggaacggttggagtggggatcggcctgcgaaaggatactgtgaaatcactaattaactaataaacctgtctcaagt

SEQ ID NO: 13107 - DNA, 1449 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgagtagctgggactacaggcatgtaccagccaccacgtccagctaatttttgttttgctttttttaagtagagatggggtttcaccatgttggccaggctgtcatctcctgtccccgcga

SEQ ID NO: 13108 - DNA, 1145 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacaggtgacatgacatgagaattgccttaaaatactcaaggaaaaaaatcctactgctgggtgtgggaggtgcttgatgaaatgagatctgcaaattgttaatagtgattcctgagtgagcacatgtgagttcattacattccttctacatttgt

SEQ ID NO: 13109 - DNA, 1069 bp, Homo sapiens
cgcccggctcctcctccacgcgcggcctggcggcggcggccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagccttgaggagcgtgagttttagtgaacttattgggctcctgctggaaacccttccctttcg

SEQ ID NO: 13110 - DNA, 950 bp, Homo sapiens
aggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaa

SEQ ID NO: 13111 - DNA, 1062 bp, Homo sapiens
aggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaaaaaaaaaaaacgacccaacaacaaacgacagacacacacacaacgcacacaagaaataggaagaggaacagacgaaaaaaaccgcccgaaatcatcgtcgggggcaaaatag

SEQ ID NO: 13112 - DNA, 2185 bp, Homo sapiens
aggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaaattccaagtctgagtttatttgcagctggggcacctcccaatattcttgttgtgcttgggttgctgggggggggttctagaattcagatattcaaggagtacaaggaaattgaagacaatttaggaaatggaagaaaatgaaaatcaattgggttctgtcattcaggattaactactgtcaacattttggaatacttcctcagttttacagttgcacttacatagtaaatgtgtaactgtaatatacaccacataatatttgcaagtttagtgttaaatttttttcctgatttttaaatctaacatgagcttttttcctctaacgatcagtgaagaaagtgctggggcaattgactagtgtctggggcaaggagttggctccctggaaaatacagtgtctccagccttagggctcttttatagattctatcagattttctgagagtgaaaaggaagaggtacaactgcttttattctcagaaaacaaggaaatggtttgatccttttgagtcttgctttgaagatgtgctgtgtgggaccagagcagctcttaactgtaggcttgtttccctctatggaggcaacaaacaccattctgggcaccctggccagtgctgcctaggtgaacatgagcttctctatcctggtgggtggggacagctgctagtccctgtcctgcttgcacactggagttaccgttcatcctctcctgctggggtgatggccttccctggtcttgggtagcttcctcacacgcctgtgctcaccagtagtcgtagtccgctgcacactggaacgggagcctctgtggatatccagggttctttccctgtgcagctctcttctctctggttctccgccctgcaaactccagctgctgggacgctctgaatcagtttcaactcctaaagtccgggtgtctgccaggctccaccaggaaactccacacaggacactgggccagtcgcatggcttacttaatactctgcattccatatattttgtctggtttggcgtgttctttcatttggcatgacatatccagtccctattactccatatggaggaacagtttccctttgtagaatctggggagctctgccagtggtgacggtggcactggccttcagcttatgaagatgacactttcctctctccctctcttttgctctcattcctttcttcctttcttaatattttttagacattaattattgacgaatagttgacaattt

SEQ ID NO: 13113 - DNA, 927 bp, Homo sapiens
aggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattcaccctcagcgtgcctttcccgacccccttggaggcggaaatcgcccatgggtccctggcaccagatgccgagccccaccaaagggtggttgggaaggatctcacaccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaa

SEQ ID NO: 13114 - DNA, 1059 bp, Homo sapiens
aggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaacgttctaaaaataaaaataattatataaaaaaactcgagggggggcccggacccaatatgcctataggaggcgattacacttatgggccgcgtttcacctcgtgactgg

SEQ ID NO: 13115 - DNA, 2162 bp, Homo sapiens
aggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattcaccctcagcgtgcctttcccgacccccttggaggcggaaatcgcccatgggtccctggcaccagatgccgagccccaccaaagggtggttgggaaggatctcacaccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaaattccaagtctgagtttatttgcagctggggcacctcccaatattcttgttgtgcttgggttgctgggggggggttctagaattcagatattcaaggagtacaaggaaattgaagacaatttaggaaatggaagaaaatgaaaatcaattgggttctgtcattcaggattaactactgtcaacattttggaatacttcctcagttttacagttgcacttacatagtaaatgtgtaactgtaatatacaccacataatatttgcaagtttagtgttaaatttttttcctgatttttaaatctaacatgagcttttttcctctaacgatcagtgaagaaagtgctggggcaattgactagtgtctggggcaaggagttggctccctggaaaatacagtgtctccagccttagggctcttttatagattctatcagattttctgagagtgaaaaggaagaggtacaactgcttttattctcagaaaacaaggaaatggtttgatccttttgagtcttgctttgaagatgtgctgtgtgggaccagagcagctcttaactgtaggcttgtttccctctatggaggcaacaaacaccattctgggcaccctggccagtgctgcctaggtgaacatgagcttctctatcctggtgggtggggacagctgctagtccctgtcctgcttgcacactggagttaccgttcatcctctcctgctggggtgatggccttccctggtcttgggtagcttcctcacacgcctgtgctcaccagtagtcgtagtccgctgcacactggaacgggagcctctgtggatatccagggttctttccctgtgcagctctcttctctctggttctccgccctgcaaactccagctgctgggacgctctgaatcagtttcaactcctaaagtccgggtgtctgccaggctccaccaggaaactccacacaggacactgggccagtcgcatggcttacttaatactctgcattccatatattttgtctggtttggcgtgttctttcatttggcatgacatatccagtccctattactccatatggaggaacagtttccctttgtagaatctggggagctctgccagtggtgacggtggcactggccttcagcttatgaagatgacactttcctctctccctctcttttgctctcattcctttcttcctttcttaatattttttagacattaattattgacgaatagttgacaattt

SEQ ID NO: 13116 - DNA, 1759 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13117 - DNA, 860 bp, Homo sapiens
  misc_feature (58)..(58): n is a, c, g, or t
  misc_feature (60)..(60): n is a, c, g, or t
  misc_feature (62)..(62): n is a, c, g, or t
  misc_feature (66)..(66): n is a, c, g, or t
  misc_feature (68)..(68): n is a, c, g, or t
cccgctcgcaatatcaacacgcgccggaaaggattgtagctaaagtgactctcttacnancnccgntncagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggacccgccggccgcaagcattccctactcaacactctcaccccccaacccaccaccccctgctacgccaaccagagtcacaaacaccactcacgatacctcacctcccctccaccgcatctccctacccggcccagcgcaccgccccctctgctgcacactaccacctgcactccaatgcccgcccccaccacccccgcccctgctctcacccactcgactagaatatcccatcacccacagtattgagcattgggcccgcccaccacgtcggcgcggctacacggcgtgcgcaccccctccagccactctaccacagtccagcctcacgagtaggcccccccccgccccccgcgttgcccccccctcccccctcccctcccccctcgcagcccccccgccccatctccgctctgtcgtcccgccgcttgctcctcaacacctccccgcaatctcacaggagccaccacatcccaccagccgcccctcacgcctccacccaccacg

SEQ ID NO: 13118 - DNA, 818 bp, Homo sapiens
tcttcgcgagaaaaatcatacatttcctagttctcgaggatttcttttagttccatgtttcctccaggccaacagtaagatgttttcacttttctttctttctttctttctttttttttttttttttcagaagaggtgtggtggaaaggtcttccagaaccagaggctaagcacacagcagtacaaatataaattctttattccagcttccagaattcctcctcttcagccttgcctgctcactggaataatgaagcaattaaacagtggtgtaaagaagttccatccagtggttgaagttcaatagaaaacaaggaaataggctgatgtatatcaaatacaccatcggcactctgagtccttcccaggttccctaattaaaataattatatgttaaataaaatatgcagatgttaaattgacttcctcctggggccacttagcatttatttcttgttacccctaagctgctgtttttcttagatttatatcttcgtgtgcagagaagaatgtcgggaagaatatacactagaatgtttacaactagagagaatgtgccaccttaggggttcagccaggagcacagagagcctgagctattccgactgtcttcttgagaatagtcctcaacccaggcctgtagaactaattctcctctgttgaggtaatcttttcagcttcttgtctatccctccagagatacatttaacttgtagtcttcctaatgaaattctatgatttggtatcttttaacattaaacttgaagacttcatttaaggcatttggtgtttaactaaaagcaaaatggcttctttgt

SEQ ID NO: 13119 - DNA, 1486 bp, Homo sapiens
gtgaagggagatgtagtcgtatagcaaagaacgcggaaggagctagcggtaagactctcttaatctaccacggctacacttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13120 - DNA, 1659 bp, Homo sapiens
agcacgaggggcgagcgctacccgcggcccccgcgcggccctccccacaaagggccgcggagctgcgtggccgccgccgccggccgtggctcgcctccgcgggcgcggaaatttgttgcacttcttggggcttgtttatttgtttgttttttctctgggtttcttatttttttcgttattttggacaaaatgtcggtccgtgatataaaaattgagcgaggaaccttggtggcattgggagctttgcagaagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13121 - DNA, 1564 bp, Homo sapiens
gccagccctgccgggtccccgccgcgctctttgtcctggccgcgcgcgggcggacgcgtgcacccccaggtgaggggaggtgtggagagcgcgcacgggagcgcgcgggaacagctcgcgcccgccgggcgtcggcggcgcgcgcccctccgccagttttccaagagataacttcagccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13122 - DNA, 1226 bp, Homo sapiens
ttgtatggaacttgactctctccttaacgccgcaccagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13123 - DNA, 1483 bp, Homo sapiens
tgtttgtgcgtgggggcgtgggtgtggggggagggggaagctggctgcaacgctctcttaatttccaccgctacagttttccaagagataacttcaccaagatgtccagtgataggcaaaggtccgatgatgagagccccagcaccagcagtggcagttcagatgcggaccatcgagacccagccgctccagagcctgaagaacaagaggaaagaaaaccttctgccacccagcagaagaaaaacaccaaactctctagcaaaaccactgtttttttattcactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13124 - DNA, 2029 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13125 - DNA, 1208 bp, Homo sapiens
  misc_feature (58)..(58): n is a, c, g, or t
  misc_feature (60)..(60): n is a, c, g, or t
  misc_feature (62)..(62): n is a, c, g, or t
  misc_feature (66)..(66): n is a, c, g, or t
  misc_feature (68)..(68): n is a, c, g, or t
cccgctcgcaatatcaacacgcgccggaaaggattgtagctaaagtgactctcttacnancnccgntncagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13126 - DNA, 1579 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatatgatgcggcctgcttaatcttcccaactctgctaatcacctaccgatacctaa

SEQ ID NO: 13127 - DNA, 1818 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacaaaaaaaaaaaaaaaaaaaaaaaaaaaaaaaaaaaaaacaccaaaaaaaaaaaaaaaaaaaaaaaaaaaaaacgaaccacagaaaaagacagaaacaacaagaaaagacataagaaagaaacaagaagaaacaaaagaggggggggggggcggcataagaataatacgccagggggggcaggcacgtaggtcgggacaacgcactatattaggaagagagggggcgcccacaaggaggggggcattcaaaataacaacgagaggcgccgggcgggaaaacacacgcgggggggaa

SEQ ID NO: 13128 - DNA, 1569 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgagagcggccgattattattaaaacaagtcgaatagttatgtat

SEQ ID NO: 13129 - DNA, 1575 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgagcgtcagaaaatgatgttgataaaagagaggaagtataaataaatata

SEQ ID NO: 13130 - DNA, 1070 bp, Homo sapiens
  misc_feature (6)..(6): n is a, c, g, or t
  misc_feature (25)..(25): n is a, c, g, or t
  misc_feature (45)..(45): n is a, c, g, or t
  misc_feature (54)..(54): n is a, c, g, or t
tggaanttctggcacgagcatgganatcacacttttcatcagatnatccagttnaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13131 - DNA, 1962 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtaaggtgtggtggaaaggtcttccagaaccagaggctaagcacacagcagtacaaatataaattctttattccagcttccagaattcctcctcttcagccttgcctgctcactggaataatgaagcaattaaacagtggtgtaaagaagttccatccagtggttgaagttcaatagaaaacaaggaaataggctgatgtatatcaaatacaccatcggcactctgagtccttcccaggttccctaaagggggaggaggggacaccgttttagatttaatttgtactgtacctgatatgattgtgataattttccaatgaataattgttaatcttacctaattaaaataattatatgttaaataaaatatgcagatgttaaattgacttcctcctggggccacttagcatttatttcttgttacccctaagctgctgtttttcttagatttatatcttcgtgtgcagagaagaatgtcgggaagaatatacactagaatgtttacaactagagagaatgtgccaccttaggggttcagccaggagcacagagagcctgagctattccgactgtcttcttgagaatagtcctcaacccaggcctgtagaactaattctcctctgttgaggtaatcttttcagcttcttgtctatccctccagagatacatttaacttgtagtcttcctaatgaaattctatgatttggtatcttttaacattaaacttgaagacttcatttaaggcatttggtgtttaactaaaagcaaaatggcttctttgt

SEQ ID NO: 13132 - DNA, 572 bp, Homo sapiens
  misc_feature (20)..(20): n is a, c, g, or t
ctagaggacccccatctctnatgcggtaagtctgtgtgttggtcttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13133 - DNA, 1600 bp, Homo sapiens
gctgcctttgtgaagttgaagagccaggagctactcagcaacaattgatttttgaaacttaactcttttggggcaaaagcaaagagctggttttctttgctagcccaataaatgctatttatgaagatggacctgttgaactatcagtacttggacaagatgaacaacaatatcggcattctgtgctacgaagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13134 - DNA, 1510 bp, Homo sapiens
caatatgaagagctacggccaagttcatgcagtcacaggcaatgacaactatatcaccaatgctgcctggctgagagtgatttaagacatcattgattggaagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13135 - DNA, 1208 bp, Homo sapiens
  misc_feature (45)..(45): n is a, c, g, or t
  misc_feature (55)..(55): n is a, c, g, or t
  misc_feature (57)..(58): n is a, c, g, or t
  misc_feature (66)..(66): n is a, c, g, or t
  misc_feature (68)..(68): n is a, c, g, or t
acaaatgggaggagatgtgaaataagaaaaaaagttatctgcagngactctcttntnnaccaccgntncagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13136 - DNA, 1582 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
  misc_feature (1525)..(1525): n is a, c, g, or t
  misc_feature (1529)..(1529): n is a, c, g, or t
  misc_feature (1540)..(1540): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacangcgntgcggccagcntcttcctctcttttgtcctacacaacaaggtgtcgcgtgcgg

SEQ ID NO: 13137 - DNA, 1574 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacagatgcggcaagtttttgtgggggaatttcatcaatatttatttatatttg

SEQ ID NO: 13138 - DNA, 1577 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgtgatacgaaaagcttttctaatatttattgtaggaataataacactaattc

SEQ ID NO: 13139 - DNA, 995 bp, Homo sapiens
  misc_feature (36)..(36): n is a, c, g, or t
gtgcggtaccgccagtcgcgcttggaacagtcaggnggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattg

SEQ ID NO: 13140 - DNA, 1868 bp, Homo sapiens
  misc_feature (181)..(181): n is a, c, g, or t
  misc_feature (204)..(204): n is a, c, g, or t
  misc_feature (206)..(206): n is a, c, g, or t
  misc_feature (242)..(244): n is a, c, g, or t
  misc_feature (247)..(247): n is a, c, g, or t
  misc_feature (251)..(251): n is a, c, g, or t
  misc_feature (255)..(256): n is a, c, g, or t
gcggccgggaggagccgagccgggcggcggcggcgggaggctacagcgcgcgggggtctcccgcgtcccctccgcctcgccgggagctcgcgccctcgcccagccgagctcccacccccgcttttttccgaagcgctgggcggcgccaccctccggccggagcccggcactgcacaacccnctccgactttcaatgttccacantncccggccagagcctcctcggcttctttttttccctnnnccnaaantccnnccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtaaggtgtggtggaaaggtcttccagaaccagaggctaagcacacagcagtacaaatataaattctttattccagcttccagaattcctcctcttcagccttgcctgctcactggaataatgaagcaattaaacagtggtgtaaagaagttccatccagtggttgaagttcaatagaaaacaaggaaataggctgatgtatatcaaatacaccatcggcactctgagtccttcccaggttccctaattaaaataattatatgttaaataaaatatgcagatgttaaattgacttcctcctggggccacttagcatttatttcttgttacccctaagctgctgtttttcttagatttatatcttcgtgtgcagagaagaatgtcgggaagaatatacactagaatgtttacaactagagagaatgtgccaccttaggggttcagccaggagcacagagagcctgagctattccgactgtcttcttgagaatagtcctcaacccaggcctgtagaactaattctcctctgttgaggtaatcttttcagcttcttgtctatccctccagagatacatttaacttgtagtcttcctaatgaaattctatgatttggtatcttttaacattaaacttgaagacttcatttaaggcatttggtgtttaactaaaagcaaaatggcttctttgt

SEQ ID NO: 13141 - DNA, 407 bp, Homo sapiens
acaaaaaatatgaataaactagtcaggaatggtggtgcacacctgtagtcccagctacttgggagcctaaggtgggaggatctcttgagcctaggagtttcaggctgtggtgagccatgatcacgccactgcactccagcctgggcaacagagggagaccctgtcccataaaaaaaggaaaatactttcccgactcctaaccctcttcttgtgctcttgggcctccagaaagcctgatgtaaatagctgtattggttctcgttgaaatctcagcgaggagcttaggcaattgccatcacaaggcttgaattatgagcccttctctccctcttaaccaaaatcaaaatgttgtgatagtctaatccagtgtttttgtttttaacttttcaaatacataaaaacaaatg

SEQ ID NO: 13142 - DNA, 501 bp, Homo sapiens
ctcgcctgagtgcttgttagatatgcatgatgtcaggcttgctgcggacctactgaacaagaagctgcagtgtcacaagatcctcaggtgtttcttgtgtgcattaaagtctgagaagccctgatctagaaaataacgtctcaactcatctgtgatgccaatattcttgtcagattgttgctggggtaggatttcagcttttggtgaacagagaatgaatcaattatctatttggtttagtgccaactataataataatatcatagagtgagctgtcatctggcattgttgggagatggagtacaggtgaacaatttgtcagctcgggcaaggtcaatagcctgctttgagaaaccttggtgggcaccacggttactatttcagagccagagagaagaaggcagagggcaacatttttcttgggatataatttttcttcccttcttaaaataccgtgagtaatgtacggggtgagggaaagatgggaaggggtcaaagttg

SEQ ID NO: 13143 - DNA, 421 bp, Homo sapiens
ccaggttcaaaatgtgggaaagcctacagaacaaataagtcagtttctttaacaaatgaatcatgggggaaaaaaagtgtccatgtatatgtgtagggggtgtaaggagtgtgccattaattaattaaaataaaagacattaacctaatgcaatattcggacttttgaggccatgaggaaacaacacagaagggtcttagaggatattaaggaatcattgtcacttgtgttaggtatgatgatgacattgtggttgtgctgaggtgatgtatctgttagaaatatatactgaagaatttagaagtgacacgatacaattgctaggctttgcttgaaaacacaccagcaagaagaacacccccacaaagaagctgagggctgacaaaaacagaatgctgctagtcatggaagccgggtgatg

SEQ ID NO: 13144 - DNA, 1007 bp, Homo sapiens
  misc_feature (225)..(225): n is a, c, g, or t
attcgagatcagcctggccaacatggtgaaaccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcgggaggctgaggcaggagaatcatttgaacctgggaggcggngcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtggtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcagtggctcatgcctataatactttgggaggccgaggcaggtggatcaattgaggtcaggtgttcgagaccagccaggccaacttggtgaaaccccgtctctactaaaaatacaaaaaaaaaaaaaaaaaaaattagccagatgtggtggtgcacatttgtagtcccagctgctcaggaggctgaggcaggataatcgcttgaacctgggaggcagaggttgcagtgagccaagatcgcaccactgcactccagcctgggtgtcgagtgaaactcattctc

SEQ ID NO: 13145 - DNA, 506 bp, Homo sapiens
aataatatactttttttttcattgacactaattttatgctgtagattattttagcagggcctaatataggctaccttacatttttcacactttctaaacttagttttgtttccatcctagaagacagtatgatattttctctggccagttgcataataactgcaaaatgtaagtataaattgatttctttttcagaggaattactaaatatataggtgtgagccaccacgtctggttgagaactgttctaagcaataaccactcacaaattttgagccagtgtatttaccatcacaagtaaatattttagaatattgatttatcgataaatctgctagcttgatttgtctgaattatttcattagtgctcctaagtgaactgataaatcggcctaataaggttgagtgcatgagataatccattgcaacagccaacattgagcactcctacagatatgatatttatttattatcataactattttacctaaggtaaaattaagtgg

SEQ ID NO: 13146 - DNA, 4199 bp, Homo sapiens
  misc_feature (2902)..(2902): n is a, c, g, or t
  misc_feature (3221)..(3221): n is a, c, g, or t
  misc_feature (3417)..(3417): n is a, c, g, or t
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacattggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattggacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatgatgaaaccccatctctnctagaaatacaaaacattggccgggagtggtggctcatgcctgtaatcccagcactttgggatgctgaggcgggtggatcacctgaggtcaggagtttgcgaccagcctggccaacatgatgaaaccctgtctctactaaaaatacaaaaaaattggctgggtgtggtggcccacacctgtaatcccagcactttgggaggtcgaggcgggtggatcacctgaggtccgaagttcgaggccagcctggccaacaggatgaaaccctgtctctattaaaaatacagaaaattggccgggtgcggtggctcacccctgtantcccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcgggaggctgaggcaggagaatcatttgaacctgggaggcggngcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtggtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcagtggctcatgcctataatactttgggaggccgaggcaggtggatcaattgaggtcaggtgttcgagaccagccaggccaacttggtgaaaccccgtctctactaaaaatacaaaaaaaaaaaaaaaaaaaattagccagatgtggtggtgcacatttgtagtcccagctgctcaggaggctgaggcaggataatcgcttgaacctgggaggcagaggttgcagtgagccaagatcgcaccactgcactccagcctgggtgtcgagtgaaactcattctc

SEQ ID NO: 13147 - DNA, 2656 bp, Homo sapiens
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacattggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacaccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattggacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttg

SEQ ID NO: 13148 - DNA, 3982 bp, Homo sapiens
  misc_feature (2685)..(2685): n is a, c, g, or t
  misc_feature (3004)..(3004): n is a, c, g, or t
  misc_feature (3200)..(3200): n is a, c, g, or t
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccgtggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattggacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatgatgaaaccccatctctnctagaaatacaaaacattggccgggagtggtggctcatgcctgtaatcccagcactttgggatgctgaggcgggtggatcacctgaggtcaggagtttgcgaccagcctggccaacatgatgaaaccctgtctctactaaaaatacaaaaaaattggctgggtgtggtggcccacacctgtaatcccagcactttgggaggtcgaggcgggtggatcacctgaggtccgaagttcgaggccagcctggccaacaggatgaaaccctgtctctattaaaaatacagaaaattggccgggtgcggtggctcacccctgtantcccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcgggaggctgaggcaggagaatcatttgaacctgggaggcggngcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtggtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcagtggctcatgcctataatactttgggaggccgaggcaggtggatcaattgaggtcaggtgttcgagaccagccaggccaacttggtgaaaccccgtctctactaaaaatacaaaaaaaaaaaaaaaaaaaattagccagatgtggtggtgcacatttgtagtcccagctgctcaggaggctgaggcaggataatcgcttgaacctgggaggcagaggttgcagtgagccaagatcgcaccactgcactccagcctgggtgtcgagtgaaactcattctc

SEQ ID NO: 13149 - DNA, 4315 bp, Homo sapiens
  misc_feature (3018)..(3018): n is a, c, g, or t
  misc_feature (3337)..(3337): n is a, c, g, or t
  misc_feature (3533)..(3533): n is a, c, g, or t
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacattggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgagtctcgctctgttgccaggctggagtgcagtggtgcgatctcggccacagcaacctccgcctcccaggttcaagcaattctcctgcctcagcctcccgagtagctgggactacagccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattggacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatgatgaaaccccatctctnctagaaatacaaaacattggccgggagtggtggctcatgcctgtaatcccagcactttgggatgctgaggcgggtggatcacctgaggtcaggagtttgcgaccagcctggccaacatgatgaaaccctgtctctactaaaaatacaaaaaaattggctgggtgtggtggcccacacctgtaatcccagcactttgggaggtcgaggcgggtggatcacctgaggtccgaagttcgaggccagcctggccaacaggatgaaaccctgtctctattaaaaatacagaaaattggccgggtgcggtggctcacccctgtantcccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcgggaggctgaggcaggagaatcatttgaacctgggaggcggngcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtggtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcagtggctcatgcctataatactttgggaggccgaggcaggtggatcaattgaggtcaggtgttcgagaccagccaggccaacttggtgaaaccccgtctctactaaaaatacaaaaaaaaaaaaaaaaaaaattagccagatgtggtggtgcacatttgtagtcccagctgctcaggaggctgaggcaggataatcgcttgaacctgggaggcagaggttgcagtgagccaagatcgcaccactgcactccagcctgggtgtcgagtgaaactcattctc

SEQ ID NO: 13150 - DNA, 2529 bp, Homo sapiens
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacattggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaa

SEQ ID NO: 13151 - DNA, 3790 bp, Homo sapiens
  misc_feature (3008)..(3008): n is a, c, g, or t
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacattggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattggacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatggtgaaaccccatctctactgaaaaacacacacaaaaaaattagctgggcatggtggcacatgcctgtaatcccagctactcgggaggctgaggcaggagaatcatttgaacctgggaggcggngcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtggtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcagtggctcatgcctataatactttgggaggccgaggcaggtggatcaattgaggtcaggtgttcgagaccagccaggccaacttggtgaaaccccgtctctactaaaaatacaaaaaaaaaaaaaaaaaaaattagccagatgtggtggtgcacatttgtagtcccagctgctcaggaggctgaggcaggataatcgcttgaacctgggaggcagaggttgcagtgagccaagatcgcaccactgcactccagcctgggtgtcgagtgaaactcattctc

SEQ ID NO: 13152 - DNA, 3953 bp, Homo sapiens
  misc_feature (2656)..(2656): n is a, c, g, or t
  misc_feature (2975)..(2975): n is a, c, g, or t
  misc_feature (3171)..(3171): n is a, c, g, or t
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaatggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacaccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattggacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatgatgaaaccccatctctnctagaaatacaaaacattggccgggagtggtggctcatgcctgtaatcccagcactttgggatgctgaggcgggtggatcacctgaggtcaggagtttgcgaccagcctggccaacatgatgaaaccctgtctctactaaaaatacaaaaaaattggctgggtgtggtggcccacacctgtaatcccagcactttgggaggtcgaggcgggtggatcacctgaggtccgaagttcgaggccagcctggccaacaggatgaaaccctgtctctattaaaaatacagaaaattggccgggtgcggtggctcacccctgtantcccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcgggaggctgaggcaggagaatcatttgaacctgggaggcggngcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtggtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcagtggctcatgcctataatactttgggaggccgaggcaggtggatcaattgaggtcaggtgttcgagaccagccaggccaacttggtgaaaccccgtctctactaaaaatacaaaaaaaaaaaaaaaaaaaattagccagatgtggtggtgcacatttgtagtcccagctgctcaggaggctgaggcaggataatcgcttgaacctgggaggcagaggttgcagtgagccaagatcgcaccactgcactccagcctgggtgtcgagtgaaactcattctc

SEQ ID NO: 13153 - DNA, 3787 bp, Homo sapiens
  misc_feature (2490)..(2490): n is a, c, g, or t
  misc_feature (2809)..(2809): n is a, c, g, or t
  misc_feature (3005)..(3005): n is a, c, g, or t
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccgtggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacaatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattggacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatgatgaaaccccatctctnctagaaatacaaaacattggccgggagtggtggctcatgcctgtaatcccagcactttgggatgctgaggcgggtggatcacctgaggtcaggagtttgcgaccagcctggccaacatgatgaaaccctgtctctactaaaaatacaaaaaaattggctgggtgtggtggcccacacctgtaatcccagcactttgggaggtcgaggcgggtggatcacctgaggtccgaagttcgaggccagcctggccaacaggatgaaaccctgtctctattaaaaatacagaaaattggccgggtgcggtggctcacccctgtantcccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcgggaggctgaggcaggagaatcatttgaacctgggaggcggngcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtggtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcagtggctcatgcctataatactttgggaggccgaggcaggtggatcaattgaggtcaggtgttcgagaccagccaggccaacttggtgaaaccccgtctctactaaaaatacaaaaaaaaaaaaaaaaaaaattagccagatgtggtggtgcacatttgtagtcccagctgctcaggaggctgaggcaggataatcgcttgaacctgggaggcagaggttgcagtgagccaagatcgcaccactgcactccagcctgggtgtcgagtgaaactcattctc

SEQ ID NO: 13154 - DNA, 2549 bp, Homo sapiens
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacattggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagtttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaaaaaaaaaaaagtcgacgcgg

SEQ ID NO: 13155 - DNA, 2539 bp, Homo sapiens
  misc_feature (1242)..(1242): n is a, c, g, or t
  misc_feature (1561)..(1561): n is a, c, g, or t
  misc_feature (1757)..(1757): n is a, c, g, or t
ttcctaactgttgagtagaaaactcaatatgtagcaatgatacaacaaaagaaaactagtgaatccccttttcttctctttcttttgagacagggtctcacaaaaaatggaatatagtaagaaacagcaatagactaaatatatgttaaataatttgggaacataaaaataagtggcatttaaatataatgtaagagcactttctattttcagttgatttttaactttgttacatacttgtgttcttttagtgtcaacatgtaagatgccagtggagctatattgtgattaacctcaaattttctttgtaggtttgatccagatcggtttgatgatgaattagtaatgaaaactttttcctcacttggattctcaggcacacaggagtgtccagagttgaggtgaataatagaatgccagactctgttcttagaattttgatgatcactgttgatgagaatgggcaatctgtatgattaaagtattatttttttattattattgtactttaagttctggggttcatgtgcagaacgtgcaggtttaaagtataatttttaatctttagtaactaattgactttcttcctgactaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattggacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatgatgaaaccccatctctnctagaaatacaaaacattggccgggagtggtggctcatgcctgtaatcccagcactttgggatgctgaggcgggtggatcacctgaggtcaggagtttgcgaccagcctggccaacatgatgaaaccctgtctctactaaaaatacaaaaaaattggctgggtgtggtggcccacacctgtaatcccagcactttgggaggtcgaggcgggtggatcacctgaggtccgaagttcgaggccagcctggccaacaggatgaaaccctgtctctattaaaaatacagaaaattggccgggtgcggtggctcacccctgtantcccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcgggaggctgaggcaggagaatcatttgaacctgggaggcggngcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtggtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcagtggctcatgcctataatactttgggaggccgaggcaggtggatcaattgaggtcaggtgttcgagaccagccaggccaacttggtgaaaccccgtctctactaaaaatacaaaaaaaaaaaaaaaaaaaattagccagatgtggtggtgcacatttgtagtcccagctgctcaggaggctgaggcaggataatcgcttgaacctgggaggcagaggttgcagtgagccaagatcgcaccactgcactccagcctgggtgtcgagtgaaactcattctc

SEQ ID NO: 13156 - DNA, 2205 bp, Homo sapiens
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacattggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaatgtaagtataaattgatttctttttcagaggaattactaaatatataggtgtgagccaccacgtctggttgagaactgttctaagcaataaccactcacaaattttgagccagtgtatttaccatcacaagtaaatattttagaatattgatttatcgataaatctgctagcttgatttgtctgaattatttcattagtgctcctaagtgaactgataaatcggcctaataaggttgagtgcatgagataatccattgcaacagccaacattgagcactcctacagatatgatatttatttattatcataactattttacctaaggtaaaattaagtgg

SEQ ID NO: 13157 - DNA, 1934 bp, Homo sapiens
agagtatcctcctcgcatcagcagaatcacattgtcactttcttcagccagtgggcaacactcaaatttaagtgtgtaacagtgtccccgggagggctctgttcaaacagattgttgtacgcgccccctacccctgcccaccccgagtgtttgattcagtaggtctagtttgggatcgagaatctttttattttgttttccttttgttttgttttgttttgtttttgagacagggtctcgccctgtcgcccaggctggagtgcagtcgtgccatctcggctcactgtagcctctgcctccccggctaaagtgatcctccagcctcagcctccggagcagctggggccacaggcaagcgccaccactgtaggctaattttttttttttttttttttttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggtgagcgccgtcttggctctctggggccccgggcgccgccccagtctctctgtcgccggcatccaggccaacctgcccgctgcgggccgcagggggcgggcctgagaggagggttcgggttcgctccagagcttcagcgcggggaccgcacccggagtcacgtgacgcccctcccggcaagctctgagagcgacgtgggctgcgtcgctacccctcaggcgccgggccaggcgggcgtagagctgctgaggaaaagcccgcgcccccgcaggccggtctcaccttgccaggcaccccgcgccactctccaaggcggctctcaagtactttgggcagctttttggccataactcgccaaacccaaatttcatttcccagtgtgtcaggacgagactcctgggcgcgccactcctttctcctttcttgaggattctcccagcacttgtgtattcctcttttccatctgtccatcgatctatcctgactggaatccaaagtgctcgaggtccaggtcttgctcctcttaggggctccaggcaaatgcttctttggggagagcgccgcgctgcgggttcgggtgcgaggtttcctctgccgctgacgcctctgcgagcctccggtcctcctctctccacttgcctccgtcagcgagagagggagggtctgaaaacaaaagtgttgatgactgaggaccgtctttaaaacctgttctacacactttgggaggctgaggcgggcggatcacgaggtcaggatatcgagaccatcctggccaacatggtgacacaccgtctctactaaaaatacaaacattagctggctgtggtggcgggcgcctgtaatcc

SEQ ID NO: 13158 - DNA, 675 bp, Homo sapiens
ttcctaactgttgagtagaaaactcaatatgtagcaatgatacaacaaaagaaaactagtgaatccccttttcttctctttcttttgagacagggtctcacaaaaaatggaatatagtaagaaacagcaatagactaaatatatgttaaataatttgggaacataaaaataagtggcatttaaatataatgtaagagcactttctattttcagttgatttttaactttgttacatacttgtgttcttttagtgtcaacatgtaagatgccagtggagctatattgtgattaacctcaaattttctttgtaggtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaa

SEQ ID NO: 13159 - DNA, 161 bp, Homo sapiens
gaagaagttcaaaaaaaattatatgaagagataaaccaagtttttggaaatggtcctgttactccagagaaaattgagcagctcaggtaagaacacaataaaaagaggagattattaaaaggtaaatttgaactggtttatctaatttaaagctattgttg

SEQ ID NO: 13160 - DNA, 379 bp, Homo sapiens
ggtttgaagtgttaagaattcttaaaatatcagacaaatccatatctaaatataactatagaaatatagcaagaaggcaaatataattgagttttggattttgcagtaatttgaatttcatgaacctttgttctcatttattgatacagttaattcagagtcaactgttgtttttctcatttttccaaattaaattgattattttgtcaaatgttgctcttttgccagagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatc

SEQ ID NO: 13161 - DNA, 333 bp, Homo sapiens
cttgcaattatggcagcgttacactctactaggaagtaaatttgagatataaggttgatttttaatttagcacctatataggtatatcctgactaaagagtacctgctatatggtaactgatactaaagtccttatgatcacagtatgtaattgtctgttgtttaccaaattaactatgctcatacatataaagggattattttacattgatttgcttgtataatagccctcactattaaataaacaatgtgtacactccctccaaataactttaaaaatcttatctttttgtgataattcagattattgaaaaatttcggggtcatcaatca

SEQ ID NO: 13162 - DNA, 307 bp, Homo sapiens
tgtctttttcttagtttatgaaagcttttgtagattatatcttttaagaataacatttctgcatcataactgttaacatacacacacacacacacacacacacacacacacacacacgcacgcacacactcactgttccccagtctgtcaatttgccatttgactttacggtatgtttttcaatctataatttgccaactaagctatcttttcctttctggttttatgatctcctgcttaaactcctccctccccattttccctacccagatacatgacatgcagacaatatacaaatattctccta

SEQ ID NO: 13163 - DNA, 861 bp, Homo sapiens
ggtctaactctaaaattcacgttcctttattgtatcttatatcccccaagtatgtaaccaaaattaatagaatataatggtttcagtttttgaaatgctcttgtctaatttggataatttagtcatttaacactttcattatgtgtaaggaatgttttagttcaatggcaaaatagtgacatagttaattgctgcttcccaaagccagcttagtgatacagctaagtgatacagctgctccttgacttacagtgggattatgtcccgataaacccatcataagctgaaaataccgtaagttagaagcccgtttcctacacctaactaccaaacatcatagcttagcctagcctacattaaacatactcagaacacttaaacagtagcctgcagtcaggcaaaatcatctaaggcaaagcctgttttataataaactgttggatatctcaagtaatttattgaatattatactgaaataacggaatggttttgcaccattgtaaagtcaaaaaattttacattgaactattacaagtcagggactgtattgtacttttcaacaaaagtacaaatagattagcaaatttcttttttttccaaatagacatattctcttgttggatattctgtatgctagttatgtgtgtgtatgcatgtacgtctatatgctgtagccatttaagcctgacagaaattgttacttgcattttctatggataactttgtttactttgtgatatttttaggagatgctatatttatctctcacaagataggaataaaattttataaattatataaatgaaacatcttctggtatttgtacaaatagaaagattttctttcaccctaaatctgaca

SEQ ID NO: 13164 - DNA, 553 bp, Homo sapiens
ccaagccatagttgtgaggaaagctaaggaagcgattactttgtattttcagcctgtaccatcaagggaggtaggttcttccagcggggaagctggttgaaagaatgcctgtcatgtaggcaactaacaatgtcaaccgtagttactatatcatatttattcttcttaaatatctatcctttttgtcctcttgttcattttcctactgccactactttaatcaggtccttatctttttttcccccttagaccattacaagaactctactactcttgcttccaatctgtctctcctccaaactgttatctcagtgttgtagtagtgatcttcctaattgcagatatggtcttgtcacttacctacctcatgttcttcagtggctctgtaataaaatcctagactggtatctggaacactttaaaagcatatacttttgtggtcaggcacagaggctcacacttgtaatcccagcactttgggagccaaggcaggaggaacacttgagcccaggagtttgaagcctccgcaacatagggagactccatctttaca

SEQ ID NO: 13165 - DNA, 232 bp, Homo sapiens
tacaccgccacccacacctcaaaaggcaaatactgacagctgtttctgagtgggtagagaacactttgaagcttttgcagaaaaaacaaacaagaatcagcaggaaagctctgataaaaagccccagggcgggggcacccatcaccgaggatgctaaactttaccattagaggaatctatactctctgtgggaactgagtggagaaactaacctaagaccttaaaaccttta

SEQ ID NO: 13166 - DNA, 220 bp, Homo sapiens
gcccagccctactccctttgattcgtctctttaaaaatgacttcacaagttttattcagtaaaaaaattcttaaaaagtaatttagaattcccataatcagaagcctatataggacctttttacgcaaagttgaagaaagttttcaattctaaagcaaatttcagctttgatttagaaaagagtacattcttttgttccagcagtgaaaagaaaaaaatt

SEQ ID NO: 13167 - DNA, 510 bp, Homo sapiens
tcgtgcattgcaaacataactggggtacattatctctatttcacattctccatctctaaattgaattcatctgtagcttggataatcacataccaaaattaggaagattctatttgtattaaattacgtagatggtataagggtgaaaaaaaaatgtagacaaggtttttaaagtgaacactagaggtaaaatcatgtacataaataatttatgattatagacaacaggaaaaatgtgagctgaatgtagacccagaataatatactactcaataaagctgctgtgaggatttttttaaaaatactttttaaattggactaataattttttttcatggaagacactttagaaaacatataaacaattagaatgaacaaaaaaagtactcataatcccactgtcaaatactgtttacttttcagtttataactttttagataaatgcacatgtaccacactgtacacatggatgtataaaacttaccctcttacattttgtaacatgattt

SEQ ID NO: 13168 - DNA, 1903 bp, Homo sapiens
ggaggagacccggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 13169 - DNA, 2477 bp, Homo sapiens
ggaggagacccggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaataaaaaaaaaaaaaaaaaaaaaaaaaaaaacaaaaagaaaacaaaaaaaaggggggcggcgcgcgcccactacaagaagtacaccacacaaggggggcgccaaacgtgaacgcccgaaccccacaggattatgtggaacaacaaggggcgaccacaataagaggggaggcgcgctagatataataccacagagcgcgagcgccgcgcgcggcgagttaaaaagaaccgggcggggagagccgggcgacaaaaccgcggagcaaaacagggggagaacatactgggagaagagcgaagccgcatcaaactccgcgaggggagaggacgaacaaacagttggggggacaaaaacacacgacaacgagacggagaaatgctaaaaaagcgcgcccccacgacggggcggaaacagctaaacaaagagccgctgccaaaaaagcgggggacaccaaacgacggcggcggccgaaaaccagacgagccgaggaaagtaacgggccggcgcgcggcgagcggggagaaggagcgcgccggcgcccacacagggagagacaacagaagccgccagcgcagccacccgtcgtaccaccgcgggggccgccgccgaccgaaacgg

SEQ ID NO: 13170 - DNA, 1564 bp, Homo sapiens
ggaggagacccggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 13171 - DNA, 1456 bp, Homo sapiens
ggaggagacccggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 13172 - DNA, 1815 bp, Homo sapiens
ggaggagacccggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 13173 - DNA, 1315 bp, Homo sapiens
ggaggagacccggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 13174 - DNA, 467 bp, Homo sapiens
  misc_feature (23)..(23): n is a, c, g, or t
ccaggcactggtggctgggagtncttcctgctgctctccggagcccccagcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 13175 - DNA, 2656 bp, Homo sapiens
ccacaagcctcctgggtgaccctgggctagaattgctgcgcttgcctcggcttggccggttgtggcctctccttgagaaaaccagggttgtgaaagactcagaccattctctcatcttgccttgtcagaagtaaattgtgtcagatttgtgctctcgctggagacctttgccccttgcgtgcccctggccgatgggagggcggtggaggctctgtaccctggcctgctggagcatctcccccaagcccactccaggccctgggaatggccagagtctaggagaggtagaaacgatcctatcagcttctctcccacccaattaggcccagagagacaaagacagatctgaaagcaaatgcaacagagaagagacacttcttagagtaaaatgtgtctcatctctatcagccatcgcctttcatcttcccaggggcctcagaagaaggaattaagttaggctgaacaggcctcagagttaggccctggctgcttgattggctgagggggaaagagttcccttttctcattcagaaaccaaggtgctgtgtctagtcagggagccttggagatgcctggactagttggaggaatcgttggcagaggatcagagaccagcagcaggctgtctgccctgtctagagctcttcccctcaacttgtctgggcccatctgggggttgccacacaacactctaacttaccttttcctgaaagaagttgggaaaccatcatcactagaggcctttgctcagagaggagctgccttaggagtcttgggtcggaggacggggctaggaattgaccagggctttgcctgccgccctcagcagtgtcgggtacattctgacctcgcctgcagctgggctgtggattcttcctgacattcagatgtgagctgttttgggagtcagctagtatggagtacgagatgcaacccagcccccaaacctacattctgcactcaaattccaaaacactgctttactgtaaagaagaggcccctggcacccaatctccctgtccttcactgtcccctcagacctgggcggggaggggggggggcctgtgaccacctgagacatacgctcgtgacactgccccaccccagccacctccacttgcttcctcctccttccctccgctgctctttccccacggcccagaatttagctgctctgacagccacttttgagaccagctggctttgcagtcacttcagagagctggagcggctgcccactgggccctgactgggagtcccctgccagctcctgatcaggcgctgcgccctggtggcagtgatgactgggagtcccctgccagctcctgtccaggcgctgcatcctggtaacagtgaggccatgttgctgtcatctccacctctgcattcttgctgcctgtgggtcctttttctttcatggagcctgctgggtcttgtctcacctgtgctgagctcctctggggttttgatttcttccttccttatcaggccctttggggtaagcctgctggttgtacctgacatagggaggcagttaggggcagtccctggtggggccgccctggcagcctccagctggcaccatcgtgtgcctggtttccctgcaacacctgcctctctgtccctgctgctgcttggctcaggcccaacaggcagcgtgcatggaggtggttacacacagctgtttccgtgagggtgaccgtgtctgcagcacgcttccgtctccgcatgcacggctgcctctccagccacctctgatacttctctcttggggccatcagagcctcccttgggctgtcacctcccagctcacacacactcttcagtggtttcctctcttcattctcttatagggcgtggtccttcttatttatctaaagggctgaatttaggagactttttacccaggggcaaaaggctcttagggtaatgagatggatggtggcccaggtgcattttccagggcctgggttctccagatcccgtggcttctgttgagtggaggcaactttgctctgtgtgaacctcgcccctgtccctctgccgggcacccctggcaggaagcaggactcccatcctcaccctgacttagactgtcctctgagtcagctcctctccaagacaggagtgggcagccctgggcagtcttctggccccttgctaaagtgaggggcaggaagctggggctgccctccagaaagccggggtaggaactctgaaaaatacctcctctaaacggaagcagggctctccagttccacttggcgccccctcccacaaggcccttcctccctgaggaccccacccccctaccccttccccagcagcctttggaccctcacctctctccggtgtccgtgggtcctcagcccagggtgagctgcagtcaggcgggatgggacgggcaggccagaggtcagccagctcctagcagagaagagccagccagaccccaaccctgtctcttgtccatgccctttgtgatttcagtcttggtagacttgtatttggagttttgtgcttcaaagtttttgtttttgtttgtttggtttttgttttgagggggtggggggggatacagagcagctgatcaatttgtatttatttattttaacattttactaaataaagccaaataaagcctctcaaaaaaaag

SEQ ID NO: 13176 - DNA, 2548 bp, Homo sapiens
gtcactcccagctcacacacactcttcagtggtttcctctcttcattctcttatagggcgtggtccttcttatttatctaaagggctgaatttaggagactttttacccaggggcaaaaggctcttagggtaatgagatggatggtggccctgggaatggccagagtctaggagaggtagaaacgatcctatcagcttctctcccacccaattaggcccagagagacaaagacagatctgaaagcaaatgcaacagagaagagacacttcttagagtaaaatgtgtctcatctctatcagccatcgcctttcatcttcccaggggcctcagaagaaggaattaagttaggctgaacaggcctcagagttaggccctggctgcttgattggctgagggggaaagagttcccttttctcattcagaaaccaaggtgctgtgtctagtcagggagccttggagatgcctggactagttggaggaatcgttggcagaggatcagagaccagcagcaggctgtctgccctgtctagagctcttcccctcaacttgtctgggcccatctgggggttgccacacaacactctaacttaccttttcctgaaagaagttgggaaaccatcatcactagaggcctttgctcagagaggagctgccttaggagtcttgggtcggaggacggggctaggaattgaccagggctttgcctgccgccctcagcagtgtcgggtacattctgacctcgcctgcagctgggctgtggattcttcctgacattcagatgtgagctgttttgggagtcagctagtatggagtacgagatgcaacccagcccccaaacctacattctgcactcaaattccaaaacactgctttactgtaaagaagaggcccctggcacccaatctccctgtccttcactgtcccctcagacctgggcggggaggggggggggcctgtgaccacctgagacatacgctcgtgacactgccccaccccagccacctccacttgcttcctcctccttccctccgctgctctttccccacggcccagaatttagctgctctgacagccacttttgagaccagctggctttgcagtcacttcagagagctggagcggctgcccactgggccctgactgggagtcccctgccagctcctgatcaggcgctgcgccctggtggcagtgatgactgggagtcccctgccagctcctgtccaggcgctgcatcctggtaacagtgaggccatgttgctgtcatctccacctctgcattcttgctgcctgtgggtcctttttctttcatggagcctgctgggtcttgtctcacctgtgctgagctcctctggggttttgatttcttccttccttatcaggccctttggggtaagcctgctggttgtacctgacatagggaggcagttaggggcagtccctggtggggccgccctggcagcctccagctggcaccatcgtgtgcctggtttccctgcaacacctgcctctctgtccctgctgctgcttggctcaggcccaacaggcagcgtgcatggaggtggttacacacagctgtttccgtgagggtgaccgtgtctgcagcacgcttccgtctccgcatgcacggctgcctctccagccacctctgatacttctctcttggggccatcagagcctcccttgggctgtcacctcccagctcacacacactcttcagtggtttcctctcttcattctcttatagggcgtggtccttcttatttatctaaagggctgaatttaggagactttttacccaggggcaaaaggctcttagggtaatgagatggatggtggcccaggtgcattttccagggcctgggttctccagatcccgtggcttctgttgagtggaggcaactttgctctgtgtgaacctcgcccctgtccctctgccgggcacccctggcaggaagcaggactcccatcctcaccctgacttagactgtcctctgagtcagctcctctccaagacaggagtgggcagccctgggcagtcttctggccccttgctaaagtgaggggcaggaagctggggctgccctccagaaagccggggtaggaactctgaaaaatacctcctctaaacggaagcagggctctccagttccacttggcgccccctcccacaaggcccttcctccctgaggaccccacccccctaccccttccccagcagcctttggaccctcacctctctccggtgtccgtgggtcctcagcccagggtgagctgcagtcaggcgggatgggacgggcaggccagaggtcagccagctcctagcagagaagagccagccagaccccaaccctgtctcttgtccatgccctttgtgatttcagtcttggtagacttgtatttggagttttgtgcttcaaagtttttgtttttgtttgtttggtttttgttttgagggggtggggggggatacagagcagctgatcaatttgtatttatttattttaacattttactaaataaagccaaataaagcctctcaaaaaaaag

SEQ ID NO: 13177 - DNA, 3269 bp, Homo sapiens
cagactcgccccgccccagagactgcgcctgcgcgggcacgagacaccctctccgcgatgactgtgagtggtccagggacccccgagccccggccggccacccccggggccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13178 - DNA, 3224 bp, Homo sapiens
cagactcgccccgccccagagactgcgcctgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13179 - DNA, 1549 bp, Homo sapiens
cagactcgccccgccccagagactgcgcctgcgcgggcacgagacaccctctccgcgatgactgtgagtggtccagggacccccgagccccggccggccacccccggggccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaaggtaggggaatggtgggccctggtgtggagctgtagggcttctgtggtgggcaaggactctgggaccgctgcaccgtcacattctcctcctttggccccagagacacatctgccttctttctttcccactgcctcgggcctttccttttctgcagctaccctcaccttttctgaggctgaagcaccgagccccacattcgtcccccccaccttcttctggcctttcctcgagatctttccctactgctcttgcctggagacagtggcctcatgggtgctgacagcgctcctgtttgtgctcagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacgggtaggtggagtggagaggctggttacagcttcagtccctttgtctgtctgtccatccattcctccatccacccatctgtccatccgcccatctgcccgtccatccatccatccactcttccaccctctaccccttaccttattctaaaaagaacttaggtaggttatggtgcctcacacctgtaatcccagcactttggggggctgaggcaggtggatcacttgaggtcaggagttcaagaccagcctggccaacaaggcgaaaccctgtctctactaaaaataaaaaaattagccgggcatggtagtgcacgcctgtaatcccagctactcaggaggctgaggcacgagacttgcttgaacccaggaggtggaggttgtggtgagctgagatcgcgccactgcactccagcctgggtgacagagcgagactatctcagaaacaaaacaaaacaaaacaacaaaaaaagaaaaggcagagtacaaggagatacatgtaacaag

SEQ ID NO: 13180 - DNA, 3221 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13181 - DNA, 3654 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggtaagctggtttacacaccccttcctgatggctgagccatcagcctataaaacatgactcagcagctgccacgccagagctgggtgttagatatggaacagaaaaacattaatggccagaggaacaccgtcccgctgagagagtgacgcggaagcaggcaagctccttggcccctccacactggtgcctgtgaaggtcctaggctctactgttcctttgtctcatttacccccatggccctggtgctcagcacaatccatgtccagcccttattaggtgtttcaggaagtgtttggatgcagagggtctgcacagggagtcaagcctggggagagggaggaaggtgagggtggcacggtcagggctggggagcccgatggtcggggtcttactcccagggatgtcctgagcagtgacgggcttgttcctacaggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13182 - DNA, 3561 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactccaaaaaaaaaaaaaaaaaaataacatgagataatagccgtagaataaaaaaagggggcggggcgcaaagaaatattccatcgggggggggcgaattttataggtgtacccacgttttttttggtacaaagggtggcccctaagggacgggattttatagagcgaagagcacgggggcgcgagtaacaacagtctgtgcgtggggaaactgggtctgtggaatttatggagagcaccatatttctggggggccatctgggccagcttaccacgagataaagctcaacgacaattcacttcagggttatcgggttacacaatgcaatgtgcgtgaagattgtat

SEQ ID NO: 13183 - DNA, 3527 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtgggtgagtggaagcaggtctggggtcttttggacgttactgtcatggaagggatggggctgagccagccaggccagttttttggggaccagacttgcagctgcaggttgtttggaatacggtttggtgacattattttactctagattctcagcaaccaaggtgcctcaggacaaagctggagctcagtctggagcctgggatgcggatccccccttccctgtgtctccctggtttgttggagaagttgaagggtcaaactgggctgggctgctgtggagcccactgatgtcttcttgttgttgccagatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13184 - DNA, 3571 bp, Homo sapiens
cagactcgccccgccccagagactgcgcctgcgcgggcacgagacaccctctccgcgatgactgtgagtggtccagggacccccgagccccggccggccacccccggggccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaaggtaggggaatggtgggccctggtgtggagctgtagggcttctgtggtgggcaaggactctgggaccgctgcaccgtcacattctcctcctttggccccagagacacatctgccttctttctttcccactgcctcgggcctttccttttctgcagctaccctcaccttttctgaggctgaagcaccgagccccacattcgtcccccccaccttcttctggcctttcctcgagatctttccctactgctcttgcctggagacagtggcctcatgggtgctgacagcgctcctgtttgtgctcagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13185 - DNA, 3369 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagctaccctcaccttttctgaggctgaagcaccgagccccacattcgtcccccccaccttcttctggcctttcctcgagatctttccctactgctcttgcctggagacagtggcctcatgggtgctgacagcgctcctgtttgtgctcagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13186 - DNA, 3355 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtgggtgagtggaagcaggtctggggtcttttggacgttactgtcatggaagggatggggctgagccagccaggccagttttttggggaccagacttgcagctgcaggttgtttggaatacggtttggtgacattattttactctagattctcagcaaccaaggtgcctcaggacaaagctggagctcagtctggagcctgggatgcggatccccccttccctgtgtctccctggtttgttggagaagttgaagggtcaaactgggctgggctgctgtggagcccactgatgtcttcttgttgttgccagatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13187 - DNA, 2816 bp, Homo sapiens
ccaagaaatagcggacagactcatagagaagtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13188 - DNA, 2866 bp, Homo sapiens
ttatttcagccttttttgtagtaagaaaaacttggaacttgcctgaatgcccagccatagaggaatggctgaataaatgggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13189 - DNA, 3067 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcacagcctgtggatcctggggcatctggaagggcgcacacatcagcagcctcaccagctgtgagcctgctatcaggcctgcccctccaataaaagtgtgtagaactcca

SEQ ID NO: 13190 - DNA, 3014 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcacttgggtttgcttggccactagggattgggcccttttgtttgctggagctcaag

SEQ ID NO: 13191 - DNA, 1336 bp, Homo sapiens
gcgtagtagaggccgggtgttaatcggacgaggaaaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13192 - DNA, 3962 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgttctatggctgctcaccatggcgataagcacttgcgtcgccatcgcacgcgctcctcatatgcctacgtagtgccttaagctaccctcaagcccctcgtccactcgctctggcttatccattcatgtatctcgtctcccatctcggcgtaatttcgtagccccttaatacactgagccgatctccctcgccattgtaacatacgcgcacctgtaatcccacgttcttgatcgtgtgcttccaagccctctactctcctcttctgttccaatccttgtctactcatcttcaactcggcctcagattatgtcctctgtcgaccgtcgactctggcagccctcgcttactcggctgcatactctatttctacgtcccgtatcctccctctacacgtctcactcttctccgcactctccactcatcgcgctattatccacctctctcttctctatcacgcatgcccctcccctcgacgctcccatatcttacccactcccctcgtgtccctctctctacatacagcacgttccttcctcctttctcatcacgccgatgcgcatcactcccgtccttcttcctcgcccatgcctgcagctttccaaccctcctttcacttctattcttctccacatctgctctctcctctcctctagcccacccatgtcatcctcactctccgactctccttcctactctcgcccttccgtcccacacttcccctctgatcacattctaccgtccctctcctcaacgactcttctatctgtccctctcactcactacttttcgctctcccatcgtccctctcgactttctcctgtctcctccgctctccacacgttccgcctcctctctctgtctcgcactacttctcaccgcgtcctccttcctacttccacactctctcttcgctcacgtctctcgcttcatctcgcctcatcctctcgactacgtgctctctcctctctattactcctctcacctctacgatccatcactccgcgtctcgtgcgcagctgctctctcacctctactcctcacacgacgatacgtccgctctctatcactgtacgatccggacttcacagcgcgctactctcaccttctcccc

SEQ ID NO: 13193 - DNA, 1228 bp, Homo sapiens
tataggctaggtacgagctggtggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13194 - DNA, 2118 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagagggcgcacacatcagcagcctcaccagctgtgagcctgctatcaggcctgcccctccaataaaagtgtgtagaactcca

SEQ ID NO: 13195 - DNA, 1381 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtaggtgatatagttcacaaaaacttgcttcagcagctgaagtttgtttattcttaggagtaataagaaaagttgtgagtggggccaggcatggtggatgacacactttgagaggcagggggtcacttgaagccgggagtttgagatcagcctgggcaacatggcgagaccctgtctctatgaaaaattaaaaaaaattagctgggcatggtggtgtgcatcggcagtcctagctactccagaggctgaggtgggagagttgcttaaccctgggaagtcaagtcttcagtgagctgtgattgtaccactgcactacagactgggcaacagagggagactgtctca

SEQ ID NO: 13196 - DNA, 1697 bp, Homo sapiens
gctggtacggtccggaattccgggattgcgcgggcacgagacaccctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcagggtagctctgtggttcctgccgtcagcctggggacactgtctaggattagaccttaccaggctttctcggcagggcttggccaatggggtcttttgaccccagggaagagggctggtggctgagtggctgctctgtgtagtgtgggcatgttggccagcaccagtggtgttagcaaggacgttcttcttggaggagctggggaggtcaagtttgtaagctcccaaagtctggggcctgggagtttcccgaattcatcctgtacccaagggtccca

SEQ ID NO: 13197 - DNA, 491 bp, Homo sapiens
tcgcgccgctgttacagtagtacagaaaaagggcccctctgagttgaggctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 13198 - DNA, 420 bp, Homo sapiens
ccctgtgctgaccagttcctgcagagagctgctctccaggtgagccagccttggtaggagccaacctttcccaactcctgagcctcagggctgcagatgtggctccagagggtgcaggttccagtgctgtgggcctcttagagcgacgggggctgcctgcgtggctgccgtctttgctgagcctaggagtgcagcgtctgcctgccagagtcccagagctgcctgcccaccaccgccttctccccacagggtcttcttggctttagtggaagaggtagaggaccgaggcactgtggttgcccagggaggcggcagggtaagctggtttacacaccccttcctgatggctgagccatcagcctataaaacatgactcagcagctgccacgccagagctgggtgttagatatggaacagaaa

SEQ ID NO: 13199 - DNA, 192 bp, Homo sapiens
atggggaaggtgcatcccaacacagcctgtggatcctggggcatctggaagggcgcacacatcagcagcctcaccagctgtgagcctgctatcaggcctgcccctccaataaaagtgtgtagaactccactgtgtgccctgtccttgggcagggagggctgctgtgagtgggagtctctgagtgggtgagtg

SEQ ID NO: 13200 - DNA, 410 bp, Homo sapiens
tggcctcccaaagtgctgggattacaggtgtaagccactgcacccggcccagtattcttaaataaatgcaaaataatctgagtatgatgttataggtttttttctaggcttaccataattctgaagtctttatactttcatacattcatgttttatttgaacatttgctcttaatttaggatgagtttatacctttaaaaagacagccttctgaaaacttttttgtgaagcagtataggaatatagctcttgtgaattttgagcatattgagtttgccttccagagcaatgcatggaattgcttaaacgtgcccatttttctaatcctaattttggtactggaataagagaacagggtgcaggactgcttggtttatagtagctcttatgtcagatttgcttgggatgag

SEQ ID NO: 13201 - DNA, 497 bp, Homo sapiens
acctcttctcagaatgtttttaaatgcatatcataaaatacttaggattacaaagaaaacaaattatactgaaatacatttctatccacagacccctttgggcggctcagcattcaaggctaataaccacttgcttccttcaatcccaactggcaaggaggagcaccaaaggaggtgacatttgtttcttagtgcatttgtttctaggtcagttaacatcttaaatgcccaaattctgaatgtcagtaagttcgatttctacatctaaacaaggccagggcaagaaagtggaataagaagaatgagtttctcctgagccttccatcagacctagtggcacaggtcatcagctaaatacacaatcttcctaaaggagggtgaccctgggctgggggccaggaagatcttgggcaccatctgcataatagtctagtaccgttgagaattctccagtgggagtttccaaaagtttggttactctttttgaaaaaaaaaaa

SEQ ID NO: 13202 - DNA, 499 bp, Homo sapiens
catagaaatgcattttagaggtgcagaggcacagagggaaatttgagccaaatgaatctgctagatatttctgcacagttttcataattcattgttaggtctggcttcaaggagggcaaagttcacatatttcttttttatattgaaataatcacaatattattttttagtaaaaatgtttgattttattccaaaaaatctttaagtaaggagtaagatttctgcatgatctgcgaaatgaaggtggaacagaatagaagccctcttctgtacaatgtcaccaaaacatcccgaagttttatcctgcctgggaaaatttcttacacatgattcttactgcttagcttgaaattgcacctaggaagaagcttttgttctcagtgctgccaaaacttccatttttcagcagtgacctcagtttaggcacctgcttataaggtgtgtttgcacatcgttggtacgttatagtgacatacatgttctcatctaggagattgtc

SEQ ID NO: 13203 - DNA, 1363 bp, Homo sapiens
ttacacagtagttttcagaaccctgtggacattattaattcatcaaagtaataggtttttaaaataaactaagatgttggctcccggtaaaatttgtacctaaatttaaaagtgcttaacatccaccaggaaatttgtgtattgctgtttattattaaactggtatgtattaataaaacctttttttcttagaatgaccttttatggaaaaactaaattttaacaatcagaaactagataaagttgaataatgtatccagcttaacatttggatatttggctcaagctcaacattcattcattcaattcaacttattaagtacctacagtgtaccagacactgttttaaatgctggaatcccaaagtaaccccaatagaaaccctgccctcatggagcttattcatgagacaatttcaggaccagtgaggagttgaaaggagctggggaaggaatcctctgctttaagtggagagatcagggaaccttttctcagatggctgcattttagactgcatttagactgcatttaagacttctacggcaagaatggcttggaggggcaggagtagaggagagagactacttaaagagcctaatattttgtgataagacttgctaacggttaggtgtagggagacaatgaggggaagaacggaatctgtgattatagctaggtttttggctgagcaattgaatggatattgagccattgactgagatgcggaaggatggaaaagaagtaggattaagggggagaagaggatcaggaattctgtcttatatagactccatttggaagatgtctattagacatatccaagtggagatagatgtcagtagatagttatatgtaagggtgtggttgtcagaggatagttggggctagagttataaatttaggaattagcagcatatatattgggtattgaaagtcttcaaacttaatgaaatcatcttaggaggaaatgaacagaatgaggaaaacagagcagaaaacaggcactaagtactttagcatttcaacatatagaggattgagaaacagagacttaaaaaacaaaggtcctaggccaggcgccgtggctcacccctgtaatcccagcgctttaggaggccgaggtggggggatcacgaggtcaggaattcgagactagcctggccaacatggtgaaacacatggtgaaactctgtctctactaaaaatacaaaaattagctgggcatggtgacaggcgcctataatcccagctactcaggaggctgaggcaggagaattgcctgtatctgggaggcagaggttgcagtgagctgagatcatgccactgcactccagcctgggcgacagagcaagactctgtctcg

SEQ ID NO: 13204 - DNA, 858 bp, Homo sapiens
ttacacagtagttttcagaaccctgtggacattattaattcatcaaagtaataggtttttaaaataaactaagatgttggctcccggtaaaatttgtacctaaatttaaaagtgcttaacatccaccaggaaatttgtgtattgctgtttattattaaactggtatgtattaataaaacctttttttcttagaatgaccttttatggaaaaactaaattttaacaatcagaaactagataaagttgaataatgtatccagcttaacatttggatatttggctcaagctcaacattcattcattcaattcaacttattaagtacctacagtgtaccagacactgttttaaatgctggaatcccaaagtaaccccaatagaaaccctgccctcatggagcttattcatgagacaatttcaggaccagtgaggagttgaaaggagctggggaaggaatcctctgctttaagtggagagatcagggaaccttttctcagatggctgcattttagactgcatttagactgcatttaagacttctacggcaagaatggcttggaggggcaggagtagaggagagagactacttaaagagcctaatattttgtgataagacttgctaacggttaggtgtagggagacaatgaggggaagaacggaatctgtgattatagctaggtttttggctgagcaattgaatggatattgagccattgactgagatgcggaaggatggaaaagaagtaggattaagggggagttgctgatcatgaaatcgaccctcagttaaacacgcactctcgataattcttattatcctgagtgtaacacgacagccaggtcatactgttcctgttgta

SEQ ID NO: 13205 - DNA, 448 bp, Homo sapiens
gaatttcaatggaaaatgagcaagcctgtttagtgtttactgctgaaccataaatacaattctattccctgctggtagaaaagccttaggaataaacgtctgattttacaaaatagtaagttaggagttccttaaaatgtcaagggggttttaaagtatgtttttacaacttgacagagtctggggagaaaacagtcttaaaactaaagtgttaggatctgctgccaactgaaaatcaatcacaaatgaagataaatcacccctgaacatataatatggaacaatgggaaaatattatcagaattgtaaaaatttgatttgcatgcaatttttcagaaacatagctttgcaagcataaattgaaacaagcagagtgattcatataatggggggaaaatcagtctaagattccaaacatgtatgtcaggagatgattatttgatgtgtt

SEQ ID NO: 13206 - DNA, 373 bp, Homo sapiens
taaatccttacaaaactctgaatccgttgtgactcaaatagtcctcatattttaattaaataatcagctgtttattgggtatttgtgtgctcaccatctttcaaggatttagagaaatgaactttactgaacaatctgagaggctgatttttattaagagtggctaagagtttccatgtagctttagtttattaaaacatatgggaatatttgacttaaattttattggaatatgctagactcagccagcatctgaaaaatgcagagcaattcaattaatcattgcaccacttcaggaaaaaaggaaccctctatccaattttactattggtaaaagttataataaaaggtttgattacaaaaattttccccc

SEQ ID NO: 13207 - DNA, 2735 bp, Homo sapiens
taaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatct

SEQ ID NO: 13208 - DNA, 2114 bp, Homo sapiens
taaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggatgttctgtatgggtgtctatacccttattccaaggtgaataaataaagttgtgtttgcctaatcatg

SEQ ID NO: 13209 - DNA, 761 bp, Homo sapiens
  misc_feature (1)..(3): n is a, c, g, or t
  misc_feature (291)..(291): n is a, c, g, or t
nnngaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggncagttagggttggatatttaatttcatagttactctttttttccacagaagaaaggccagcctgacccaagttgcctatttttaatgtgttaatgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 13210 - DNA, 335 bp, Homo sapiens
gattagctctatcaacaaatcatcctctttatatttttatgtaataagttatttgagattataacaactgaatgagatttccttcctttaacattatagtctgaaattgcaaaagctcctttttaactacctggacaaaatccagttaaatgttatgttatgaaattctggccagcatttcaaaacaattcctctattcaatacactgatgataattaccttttttcagaggataatttttttgttaattatgcttagagtgtcacttagatatggtatgctgtgtttagagtctgcttagcaaagcatgattttttaaaagaaatacaacttta

SEQ ID NO: 13211 - DNA, 2091 bp, Homo sapiens
aaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcacccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatgggggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctca

SEQ ID NO: 13212 - DNA, 798 bp, Homo sapiens
aaactaaggctaggtagaggctgggtgtgaatcggaagaggctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctca

SEQ ID NO: 13213 - DNA, 387 bp, Homo sapiens
gcgcgattcatcatcctgctcctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccccaaagtaagaggccttagtagaaaagcacttccacctgcagttttcccctaggtctgcagagagaaacagtgcagagtgcaatgccacagtcaaggaccacttcctacagagcccgggccccagggagggtgtcgaggatcctc

SEQ ID NO: 13214 - DNA, 334 bp, Homo sapiens
tactactaaattcgcggccgcgtcgacagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtccagggcagaggaccaacgtcgacgcggccgcgaatttagtagtagta

SEQ ID NO: 13215 - DNA, 6932 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13216 - DNA, 7618 bp, Homo sapiens
  misc_feature (7317)..(7317): n is a, c, g, or t
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaaaaaaaaaaaaaaaaaaaaaaaaaaaaaaaaaaaaaaaaaaaaaaaaaaaaaaaaaaaaaaaaaaaaaaaaaaaaaaaagcagagaccaaaaacacacaaggcacaaacggcgaccatgagaacagaaacgcggcaaccacacgtgtaggccccaacagaaacgcctcacagatggagcgcagccatcaataaaagaacgcacgccatgcacaccaacttctcaaccacagactatactcaatgacagaagcaccacaacactgatctgatcggatcaaacatacagcagacccggacccgcccgataagtgaatcaccccacaccacacaaaactatccacgcgaaggcaatgcacgaaacccacatcctccatttactgttagntgccaaaaactcttcccgactcctaggctcgctaacgcaaccctcacactcgtaccgacaaataacaagcaacaccgcacacccatctgtacagaacacagccacaaccaccaacacaatcagacaacgacactgaaccacaccacgcaaacaacaacaacgccagacccaaaccaacaaagacgaaccccccaaaacacaaacaaggacacaccacaccgcagacacaaacaacacacgcaccacagacaaccaaccagacgcacgaacacgaactaatcgaaaagacaccaacccccaa

SEQ ID NO: 13217 - DNA, 6511 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13218 - DNA, 5048 bp, Homo sapiens
attgtgatgatgagtgatgtctgaagtcggcttaccggcctgcgaacttggcgctgacctgtccggttctgccgttcatgtgctgagcgtgccctgaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13219 - DNA, 4959 bp, Homo sapiens
tcgatctagaggatccctgatgcatgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13220 - DNA, 3512 bp, Homo sapiens
cgtacgcgtgggtccggacgcgtgggctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13221 - DNA, 3282 bp, Homo sapiens
cgacccacgcgtccggatagttctagatcgcggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13222 - DNA, 5763 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctca

SEQ ID NO: 13223 - DNA, 3260 bp, Homo sapiens
aaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcacccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatgggggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13224 - DNA, 4519 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtccgttccgttaaccctcgggtctctagac

SEQ ID NO: 13225 - DNA, 1854 bp, Homo sapiens
ggacgcgtgggtcgaacccacgcgtcggaccacgcgtgcgcagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13226 - DNA, 1707 bp, Homo sapiens
gcggggttcgcggcccgtcgaccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13227 - DNA, 938 bp, Homo sapiens
gcgactatagagcatccccgaacgggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13228 - DNA, 768 bp, Homo sapiens
tgccatttactccatggcgcaatgctctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13229 - DNA, 1706 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacactccagaccagacagtctctcaactcgaatgatttcatgacaccactgcccagtaaacattcag

SEQ ID NO: 13230 - DNA, 401 bp, Homo sapiens
gagcaagactccgtctcaaaaaagaagaaaaccaccaccaacaaaaaacacatgtaaataattcacaacagtacagaacagtatgaagcagaagccaggattcctctctctccatcaagtgtatatctttctagtgttaggtttcatttcaaactttaaaaatcattttgtgtgctattttaattaattgctgtttctgtggtggtgggtcagtatgtcttaattctgaatgttttccctgcacctcctaaaagatcttttctcccctcctaacagaatggtatattcctctggaaaaagatgaacgtcaccaatggattgtgctgctctcgtttcagctttgatttttttgtccttgagaaccttgtcctccctgctgatttgtttctaaatcaaaagaa

SEQ ID NO: 13231 - DNA, 6986 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtatgtcttaattctgaatgttttccctgcacctcctaaaagatcttttctcccctcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13232 - DNA, 6758 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 13233 - DNA, 7195 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctatagtcagctaagggcttccctttctgcgcccagcttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaatggatttaatacatttatttatttatttattttattttatttttgagacagagtcttgctctgtcaccaggctggagtgcagtggtatgatcttggctcactgcaacctccgcctcccaggttcaagcgattctcctgcctcagcctcccgagtagctgggactacaggtgcgtgccaccacgcccagctaatttttgcatttttagtggagacggggtttcaccatgttggccaggatggtctcaatctcttcttcgtgatc

SEQ ID NO: 13234 - DNA, 6003 bp, Homo sapiens
  misc_feature (5991)..(5991): n is a, c, g, or t
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgagcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgaatgagggtgagctggctgaggcatcgctcaagctggggggtggtgtgtaagaagcacgtggagccacaagaggcacctcctgtgacaaagtgaatggggancgagctcatcag

SEQ ID NO: 13235 - DNA, 4519 bp, Homo sapiens
  misc_feature (4494)..(4494): n is a, c, g, or t
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcctncgttgaagcgtcgggtaccgagctc

SEQ ID NO: 13236 - DNA, 4475 bp, Homo sapiens
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaaggaacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctcttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtctcgacttagcttgttttatcctctagagtcagatagaa

SEQ ID NO: 13237 - DNA, 1572 bp, Homo sapiens
  misc_feature (1361)..(1361): n is a, c, g, or t
gattatcccaatatggggagaaaataaatatgcatagaggaaaagagaaatacactaattaagaagggaaagagtcctttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcttcccactcggcgaccgtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactggcgtgtgagtgtgcagattcccctgtgtggtcgaacctaagaactgtggcttggaagtgatgctccatgtgacgacgactntgctttctttcctcttagtaagcaggtgattggtagatcccaactgcctatgtaatgtaaataatgtacatttaagtttattgctatggtagcacattgtatttgttaatgtacaaaacaaattctaaaaggttgacaaatgtatattttgttgcttaaatgtgtctttgcaaaaattgacaataaataccatattttgtgtccaaaaaaa

SEQ ID NO: 13238 - DNA, 405 bp, Homo sapiens
tctggtcctataattatttattgaatgaatgaataagtgtatgaattatgaaaagttggtaatttctgaggtcttaacatgatttatttaaattatttttagagtaatattaattctatggctcagtttatttaacatccatccagagcaaaatgggttcttcaagtaatataagtatataaaaggaatattaacctcatccctgcccttgggtgcagtataatctagagtaagaaatagcatgacattcgtcatttaattttttcatttttaatgtactttttaaaaaccgcatggtttaatatagaattagaataggtggttaactttctctgtgtttcgtatgtatagcttatgtgatcgcaaattattaatgaaaaagcaaacggagtcaaaaaaaaacaa

SEQ ID NO: 13239 - DNA, 432 bp, Homo sapiens
gatgatacttgcacacgtgttcctcagccttgggtttgccactcctgctatccttggaagttggctgacttttgagacttacaggaagagagtaaacatacatttacaagtagtagtcaagtttctgtgtattgcttggacatatacgtggaaccttctaattggcaataatacttttggaaataaacattgcatgtgtggtttttttttgttgttattttttagatagaagcgagaatttgcctaaaaaacaaaaacaacaacaataaaaaagaggggtggtggacttaatcataagaaatagttatttgcaggccaggcgcagtggcttatacctgtaattccagtgcttttggaggccaagttgggaggattccttgagcccaggagttcaagaccagcctgggcaacatagcaagaccctgtctgtac

SEQ ID NO: 13240 - DNA, 801 bp, Homo sapiens
tgtcagggaagtccacgtttctggtgattgcgggtatggattggaaaggagattactcacaactgcccgtcccaactttgcttaagcaattccagggtgaggcattcgcaactttataaagagcaaattccattttaggattgctctagcttttaaaaaattcttcttaaagttgatccaaaattggcctccctgtaagcttctgaccgtttgtctgagttccgtactctggagccaggagggtcaatctacttccctccctccatgatagcaccttcagtaccagaggatggcagtcgcaccacctataagtctgtcttccttgctgcgcatccttgtgccttcaaccactctgcggggattctgactctctgctctgttggctgcactccaccttacaagctgcagctccctgtgggcccctgaaatgtgccctgggttacatactgcactgcacacaccgtctgagctgcacagggcatgggcagagcattacctcctgaatttaggacactgttcttattaatgtgctccagcctccacaccatcacacttacgcaactggcgtttttcattccgtcagtcactcaacaaatattgccttcaagaaaattatttccataccaaaagctgagaattttccatgagatgactgagagacaaatagactaacaaaacacgtgtacttctgacctatggttgaacctgaaattatatttttccacacatttaaaagctaactacatcatttatcagttagtggttaaagggcaaagccaccatgcagaattctaacaatat

SEQ ID NO: 13241 - DNA, 432 bp, Homo sapiens
cctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgccagaggtttattccaagcctctgacagtaggagtcctgaaatccacctggtggatgaaggaggaaacaaaatttagaggacttggcagaatcacagaatgtggggagatgtttccaaaggggacctcatctcatgctgcaaacgttttgtctggagaatacc

SEQ ID NO: 13242 - DNA, 566 bp, Homo sapiens
agcagggaggagtcacatctcctagatgatgaatgcagagatatgtcacgaggctcttgagagtggtagggctaaagccctgtttgcagggcataggcagacacttcccatcttctaggtgtttggcccagtgatatgttacagttctcaaaacgagtggggctgatgcaaaagacaagagtcacattccctaggtgctaggtccagtgatatttaaccatcccgcacctgacagaaagagaagaacacatcacctaaatcataaatgtaaaagtatattgtagacagctgtgatggctcatgcctgtaattccaatgctttgggaggctgaggcaggtggattttttgtaatcagaagtttgagatcagcctggaaaacatggcaaaactcaatctctactaaaatacaaaaaaagaaagaaagaaagaagaaagaaaaaaagaagaaagaagaaagaaaaagaaagaaagaaagaagaaagaaagaagaaagaaagagaagaaaaggaaagaaagaagaaagaaagaaagaaagaaagaaagaaagaaagaaagaaagaaagaa

SEQ ID NO: 13243 - DNA, 232 bp, Homo sapiens
ggactactaggggctcagactcttcaagaactaaagtttgaattacaccactaagtaaataatatcaacctgaggaggacctgcttgagattaaaggaaacatgaggctgggtgcattgactcatgcctgtaatcccagacattgggaggccaaggcaggaagatggcttgaacacatgagttcaagacaagcctgggcaacatggcaagacccctgtctctacagaaattt

SEQ ID NO: 13244 - DNA, 373 bp, Homo sapiens
aataatcacagactgaaaatttaaatttttattatacaaataaacttgaaaacatagataaagttggtaatactcttaggttatataaatgacaaaaactgattctaaaacaaattgaaaatatagatagaacaattcatgtagaagaaataccataagatattaaagaggtaccttatcttctatccccaacttaggcaacccccaacccctaacataggcaccaggcccagatcatttcacacgaatactattaaagctttactacaaagacaaaattgatgctttatctgtttcctaaagctttataagtttcttttataagcctataaattctttttacatacatagtatttcaaaacttgatagcatc

SEQ ID NO: 13245 - DNA, 125 bp, Homo sapiens
agcctgggtgttagaaattgtttttgactgattcaagataacatgttatctttcttaattcatacagctttgtcaaaacagcactagattaagatgaagtgccaaccaatactttgaaatttaaa

SEQ ID NO: 13246 - DNA, 282 bp, Homo sapiens
tggcgtgtacacagaaaactataaaacactgttgaaagaaattacagattgaatgcaatccctatcaaaattccaaatgccatttttttagcaatggaaaagcagatcctaaattcatattatgcaagggacccagaatacccaaaatcatcttgaaaaagaacaaagttgggatgactcgcacctcgcaatttcaaaattcattacacagctacagtaatcaagacactgtgttactggcatatggatagaaatatagatcaatggagtagcattgagacc

SEQ ID NO: 13247 - DNA, 326 bp, Homo sapiens
ccagcagccatttggaagtctaattagtccctggcgggctgtggtctaccctgcactcccaagccctacccagactccagcccagaggctgtgggctcccactacaacagcactagccacattcttgagtagaaatcatggtagatactaactcaaatctctcctcctccctgcttctctccctctgtccagcttagcccaccccaggcagcccaagaagaacagtgcctctctgagcatgagtcgtccgcccccatccccaccccgcccctgtgagtcgtttcaggagacagtgtggtgtagtggaaagtgtcttagcctggggg

SEQ ID NO: 13248 - DNA, 626 bp, Homo sapiens
tagtagagacagggtttaaccatggtctcgatctcctgacctcgtgatccgcccgcctcagcctcccaaagtgctgggattataggcgtaagccactgctcctggcctataaacaactcttaaaactaacaataaagttgaataatctgatttggaaatggacaaataattgaactaaatttttaccaaaaatatacacaaatgggaagaagcatttaaaaagacacaaaattacaatttgtagagaaatgcataaaaatcacaatgaaaaacaaaatcacctatcacccatttagaatggctactataaattttttaaaaatacaaaatctgttgatgatgcaataaaaataaaaccatccaggtaggtacagtggctcacatctttaaacccagtgctttgggaggctgagacaggtgaatcaccataggtcagaagttcgagatcagcccggccaacatggcaaaaccccatctctactaaaaacacaaaaattagccgggcatagtggtgggtgcctgtaatctcggctaccctgaggctgaggcaggagaattgtttgaacctgggacatgagaacaaatcactgcacttcagtctgggtgacagagtgtgactccatctc

SEQ ID NO: 13249 - DNA, 373 bp, Homo sapiens
gaaaaccctgacccccaaaaggaccctcagtcatggctgctcgctcactgtcactaaagaacatcctcattccattcctacctcttctctaggagaccccacaattggagggcctgtaggagggaagctggggagggacagacagtacccaccctcaggcatggaccctggtcaaagagaagaatgcccctctctaggatggaatattttgcatcaactttgaaataacattttcacaccaagtgtctgttcctttccctttctcatggaaatccccagtctcatgccatcaggtgccttacagaggcttagtgctggcggcaagtgtgagggtctctaaatcttcctctaatgtctgcaagtgccgctgcga

SEQ ID NO: 13250 - DNA, 1553 bp, Homo sapiens
aaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctcttta

SEQ ID NO: 13251 - DNA, 358 bp, Homo sapiens
tgggcattgccctctggctggagtcagtcaagaagatcccaggtcccaggggctggtcagaggcctggactgtgggagcagtgggggcttgagaggaggtgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctcttta

SEQ ID NO: 13252 - DNA, 1582 bp, Homo sapiens
aaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctctttaaaaaaaaaaaaggggggggcggaaaagaa

SEQ ID NO: 13253 - DNA, 1198 bp, Homo sapiens
aaaatatttcttccctccctagcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctcttta

SEQ ID NO: 13254 - DNA, 2360 bp, Homo sapiens
aaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctctttatctgtgctgtgccggaatgtggttctttctcagatgggggtttggggcaagtgaggtggtgatgccctggaaggctcctaagaggggaaagggctccctcttcctctccttccctctcttcccaggaggggcagctgggcaggcagaattagcaggtgacatcactctcatgggtacagttcatgccttacgcatgcaaatagtaccccctgagttgtgcagaattcagctcatgctctacttggcagccctgtgagcagtgtccttgccaccaacctggactctgtctcatcctgcccagctgccccaaggaggctggcaggcttggagctcagaccagctcttcctccagctgcagggccagcggctgcctcttcctaacagctaggccagaaccctggtgtcctgctaaaggagcacgtgggttagggtagggtgatgacaacttctaaggcaaggctaatggcagggacctgtagcctggaggacctggtgtcccttttactttcagagtctgagtgctcactgttgcctccgggagtgtggtgttgcctgtgccttccccattgccatcacctgccctggtttacccacactggaatgcgggccccaagtttaccccctgcctgtccccagatgttcttgtctagcccttggggacagatcacagctccaggatctcagcctgggcctgagctcctcatcaggagtggcctcttagtgctactcaatccctgaacttgcagaatggggcagacccaaaatgacaggctctagcagcagaagagcttgaggccaagggctggg

SEQ ID NO: 13255 - DNA, 373 bp, Homo sapiens
gaagtaccataacacaactagaatatatctcaatattgattgttctgcatcaatttttgatggtagagactttgtcgttttgaggagcaggttcaattcttcctttatttctggaaacttttcacatatggcatctgtggatatttttctatcccatttattaggctctttacttaaggcatgtaaattatcttaatgttggatcagcattagcgtgaccatctaaagtccttcctccatgcccttgtttcgatttgtgtgcatgtctcttctgcatcttgctcttcctaatttacttctttgatccaccatgtggttctttgagttctcggtttcttttctgagctcagtaatctccttttttaaaaaaaaa

SEQ ID NO: 13256 - DNA, 508 bp, Homo sapiens
agcctcacttagctttgagacagcattttgcagcaaggtaatctttgagtcctgaatgcattttggagccttaagataccgaatgagatatgtgccctgtttggactgtatgattttatagcaatggtcttttagtttatttctaagaaaaacaaactgtttgaataatccccataacatgtcaccagctggagttccagaacggggaatctatcttgccatgcgtttcaaccttgagagcccaaactgtaaataaactcatttaggtgattcagtttaatgccaactacacaaagccaaaataaaatccgagcgcgcaaatgaactgaaagataaagtttgtactcatcaggaaagacaagctttctttaacaggaggggaatataatccctcctaaacagaagacctcataaccaggatggacaaaatccctcataaacaggaggccttatgtccagcaggtagaaaatccctcataagcagaaggcctcatagataggatggggg

SEQ ID NO: 13257 - DNA, 689 bp, Homo sapiens
tcctttaacctataatgcacacagtgttttcttaatagtatgtgactgtagtcgtataatactggtttaagtcaaatatgatttgaagattactaaatggtattaggtatcttcaaaccaatgatggataagtaaattcccaatatttaatttcagtataaaactgatctagcggtcttaatttggctgctctacagggcataagaaaagttatcatttggaacaaagagctcttttatgaatatgaggttttcaacttaaaaaaacccaacaaccataagacactatccacatatgctttacattttttaacacattttcatatgtatgatttcattcagtcttcagaataaccctatgtaataggtatcacagtgttcgttttatagattaagagagtgaagaaaacgagttcacattaaatggtaaaaataacacagcttgtgggcagagccacgacataatccgagagtcttgactccaaatcccatgccctctccactaaagctcgctatattaatctgaaaatgcctgtaaattgtagattatcaaaagtagttgttatttctctaaaaaatctacctagagaagaaggaaattgaagaattccaagcaaagaaaataaaatctttggtttttgacaagtgacagggttgccacagatgtaggcgctcccatcttccccccac

SEQ ID NO: 13258 - DNA, 483 bp, Homo sapiens
agctgtggaggaaggagagctgttctgcatccataaaaaccagttaaaagggatttcataaggtctgaaattgagaactttcccaagaatactgcatcttgttctcttgtgcaatatacagacgtgtgaatattcctaacagtaaccaaatgggtgcactctctgtgaaaacgcatctttcaaagagttttttaaacaaaggagactcctgggcctttagaaataattgccacaaactgcaaaaacaatctccaacctcccacttctgtaattctcatctgttgtcttactagaaaatttatttctctggtaataatgttataattgatatccctgtcttctcaagatgtaaaatacttgtaaaaacttctctgtccatcagaaaataattattggcacttttcttctctctcatgtgcatgatggaacaataaaaagcttatggctttgctagatctattatttaacaaacaatttgagagt

SEQ ID NO: 13259 - DNA, 7020 bp, Homo sapiens
  misc_feature (687)..(687): n is a, c, g, or t
  misc_feature (1757)..(1757): n is a, c, g, or t
  misc_feature (2954)..(2954): n is a, c, g, or t
  misc_feature (4241)..(4241): n is a, c, g, or t
  misc_feature (4770)..(4770): n is a, c, g, or t
ggctccagctccagcagccatggcgccttgtgcagcctcctttgtgggtggagaagagctcagccaaccttggatggagcgtcggtgaagcaagagctcagaggggagaggggctggcctggcatgaccgtcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagnggaagaacgccgagctggcggtcattgccaagcgcctggaggagagggcccgaaagctgcaggaaacgaacctgagggtggtgagtgcccccttgccccggccggggaccagcttggagttgtgtcggaaggccctagcccgccagcgagcccgggacctcagtgagacagccagtgcactgctggccaaggacaagcagattgctgccttgcagcgggagtgcagggagctgcaggccaggctcactctggtgggcaaggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacangaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagantgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcnggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatngggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaa

SEQ ID NO: 13260 - DNA, 7164 bp, Homo sapiens
  misc_feature (687)..(687): n is a, c, g, or t
  misc_feature (1577)..(1577): n is a, c, g, or t
  misc_feature (2774)..(2774): n is a, c, g, or t
  misc_feature (4061)..(4061): n is a, c, g, or t
  misc_feature (4590)..(4590): n is a, c, g, or t
ggctccagctccagcagccatggcgccttgtgcagcctcctttgtgggtggagaagagctcagccaaccttggatggagcgtcggtgaagcaagagctcagaggggagaggggctggcctggcatgaccgtcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagnggaagaacgccgagctggcggtcattgccaagcgcctggaggagagggcccgaaagctgcaggaaacgaacctgagggtggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacangaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagantgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcnggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatngggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcaggtatgacctgctgctgtccctcacccacctcccaccagcccccttccaactccacctgaccctgagcaattgttgtgtctggggtgctcccacttacccagactctagcagagccttggagcctgccttgaaccctgctgcgtagtggtcagactgtacgtgggctggccgcgtggagtgggcgtctgttgcagaggggaatacagccatgcagccaggaattttgggtcctggaggttgggtggggctcttgtcagggatgggagatgaatgcccttacgaaacaagctcagtaacctagcacggccctgagaggaaactccagagtcccagtcctgtctctcccacctcccctgcctcgctttctctctgcttttctggatcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcaggactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaa

SEQ ID NO: 13261 - DNA, 6751 bp, Homo sapiens
  misc_feature (687)..(687): n is a, c, g, or t
  misc_feature (1577)..(1577): n is a, c, g, or t
  misc_feature (2774)..(2774): n is a, c, g, or t
  misc_feature (4061)..(4061): n is a, c, g, or t
  misc_feature (4590)..(4590): n is a, c, g, or t
ggctccagctccagcagccatggcgccttgtgcagcctcctttgtgggtggagaagagctcagccaaccttggatggagcgtcggtgaagcaagagctcagaggggagaggggctggcctggcatgaccgtcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagnggaagaacgccgagctggcggtcattgccaagcgcctggaggagagggcccgaaagctgcaggaaacgaacctgagggtggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacangaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagantgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcnggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatngggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcaggactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaa

SEQ ID NO: 13262 - DNA, 1860 bp, Homo sapiens
  misc_feature (687)..(687): n is a, c, g, or t
ggctccagctccagcagccatggcgccttgtgcagcctcctttgtgggtggagaagagctcagccaaccttggatggagcgtcggtgaagcaagagctcagaggggagaggggctggcctggcatgaccgtcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagnggaagaacgccgagctggcggtcattgccaagcgcctggaggagagggcccgaaagctgcaggaaacgaacctgagggtggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggtggggcggcagtgagggaagctggcaggctgctggacaccagctttgccactcactcattccacaagcatttactgtgtgcccggcactgtgctaggcgtcggggagactgtggggaacaaagaccaggtccctgagcagtcagcaaattagcatccaggagtgagctgatttcagacactgatgagcacagtggtggagaagaacagggtgatgtgacaaagtgactgggatggggtgaggagccactttagaggtcatcagggaaggcctccctgaggaggtgacaattgaccttgccagccaggaggtgtagacatgcacatgctctgtggcagggaagagctgaagaagcctgagaccaatgtggctagaatacagcaagggatgggcagcgtggtgggagtagacaagaacccga

SEQ ID NO: 13263 - DNA, 6840 bp, Homo sapiens
  misc_feature (687)..(687): n is a, c, g, or t
  misc_feature (1577)..(1577): n is a, c, g, or t
  misc_feature (2774)..(2774): n is a, c, g, or t
  misc_feature (4061)..(4061): n is a, c, g, or t
  misc_feature (4590)..(4590): n is a, c, g, or t
ggctccagctccagcagccatggcgccttgtgcagcctcctttgtgggtggagaagagctcagccaaccttggatggagcgtcggtgaagcaagagctcagaggggagaggggctggcctggcatgaccgtcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagnggaagaacgccgagctggcggtcattgccaagcgcctggaggagagggcccgaaagctgcaggaaacgaacctgagggtggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacangaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagantgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcnggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatngggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaa

SEQ ID NO: 13264 - DNA, 7386 bp, Homo sapiens
  misc_feature (687)..(687): n is a, c, g, or t
  misc_feature (1577)..(1577): n is a, c, g, or t
  misc_feature (2774)..(2774): n is a, c, g, or t
  misc_feature (4061)..(4061): n is a, c, g, or t
  misc_feature (4590)..(4590): n is a, c, g, or t
  misc_feature (7299)..(7299): n is a, c, g, or t
ggctccagctccagcagccatggcgccttgtgcagcctcctttgtgggtggagaagagctcagccaaccttggatggagcgtcggtgaagcaagagctcagaggggagaggggctggcctggcatgaccgtcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagnggaagaacgccgagctggcggtcattgccaagcgcctggaggagagggcccgaaagctgcaggaaacgaacctgagggtggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacangaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagantgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcnggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatngggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcaggtatgacctgctgctgtccctcacccacctcccaccagcccccttccaactccacctgaccctgagcaattgttgtgtctggggtgctcccacttacccagactctagcagagccttggagcctgccttgaaccctgctgcgtagtggtcagactgtacgtgggctggccgcgtggagtgggcgtctgttgcagaggggaatacagccatgcagccaggaattttgggtcctggaggttgggtggggctcttgtcagggatgggagatgaatgcccttacgaaacaagctcagtaacctagcacggccctgagaggaaactccagagtcccagtcctgtctctcccacctcccctgcctcgctttctctctgcttttctggatcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcaggactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaaaaaaaaacacaaaaaaaaaaaactcgggggggcccggacccaatcgcctataggagtcgattacaattattggcggcgttacacgtcggactggaaaccctgcgtacccaactaacgcttgaagaaatccctttnccgctgcgtatagcaaaggcccgcacgacgccttccacaatgcccacctgaagccaaggcaaatgaagcttatattgtaaaatccgt

SEQ ID NO: 13265 - DNA, 427 bp, Homo sapiens
gacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaaggtaacggggtagggatgggctgttgggccccaggcctcaaactccggggcctccccactgtgtgtcagcaggtgctctgaccaccactgagtgccagaaacattctaggtctgtggcctgggccctgtcctaagcagaagataggaagtgccccaggattggcccctgccctcctggaaagaaaggggaaggggaggagttcatttctgtaccttctctccctccagcccaccagatacag

SEQ ID NO: 13266 - DNA, 386 bp, Homo sapiens
aaagtagatatgattctttctctaatgcagcttatattttgatggaatattttagtatttctataaataaataaagatatgtgttacaaagaaaattaaagagatgtgataatgatgaaatgggataatttgcttgggtgcccaggaaggttactttgaggaagtgacattggaactgagactcaaatgtcaagttttaaatgtaggaaaaagctttgcatgcctgaaaaatggaaagatgaatattatggcttgaggctgaaggggcaaaggaagtggtgtggaggtgagtggaaagattccaaggtggtcttttcacagaggagggtgagggagctaggtaatgtcaaaagctgacccatgttgctaggctgtcaaaagtacca

SEQ ID NO: 13267 - DNA, 462 bp, Homo sapiens
ctcttagatctagctggtattcaacaatttacatgatttaatcctaacttcaaattatattattgttcatctcactgcatctcactgttcatatgatttcttaccttcatacctttccttgagcagtttagtatgtcattcctttctccacaccacccccacactcatttgcaaccaggaactaagtgcagtctgtgcagtgtgaaatgggtagcaatggcccacacatggaaaaacatatagcctttctggtctagtgaatcagaaaagagaaactgggaaaaaaaataatgcaaaatatacctgagtgcagtggtgtgtgccattagtcccagttattcagtaggctgaggcaggaggatcacttgagcttagaagttcaaggctttagtgcactataattgtgcctgtgaataaccactgtattccagcctaggatacatagtaagaccccatctcttt

SEQ ID NO: 13268 - DNA, 461 bp, Homo sapiens
ccaatttggaggtcaaaaagagaccaaagtctctgtacatctcacatgactttacttgcattaactttgccttcctaaattacagtctataattaagaagtgctagtctcctggccagctcttatggttatttttgaagctccttgggtgcttgcctcttccagagggctgttactttgccccctctctggaagctcatttgcttccacaggaagccttaagccaaagcacattggcttattcaatctggtgtctggatcttaaaacctggcttctcagtttatgatgctcaccagtaaaacactcatggctcttcttgccatgaagcgaaccagggcttgcttagcttagctttcatgtgtgggccttcgtgaatcaaaataaggaaggaaggtaggaactagtcccacccttaagtcaagaaggaactggttagtcatgaagtgaagccacatgacttt

SEQ ID NO: 13269 - DNA, 482 bp, Homo sapiens
tagagacgggatttcaccgtgtgagccaggatggtctggatctcctgacctcgtgatccacccgccttggcctcccaaagtgttgggattataggcacgagccactgcgcccagcaagatttttttttttaaagctcagataaagtattatggaggcgaagaagtaggtaactcactggagtacttgagaaaggcatcatatttcagctgggtcctgaagaatgagattttccatataagaagcagaggaggaacattctaggtaaaaggaagggcatatgcaaaaacacgagggttgtgaaaggacctgattggactgagatacaggaataagcacggaggatatctctggggatctttttccctaatacacagttatagttatatccatattgggtttcttgactgttgacttcaggaggttctcaactcaggcaggcccccaatttccagaggagataaccttaaccaatgttttgggt

SEQ ID NO: 13270 - DNA, 368 bp, Homo sapiens
actcaagctagcctcccacctcagcctcccaagtagctagcactacaggtgtgcaccaccacagccagctaatttttaattgtatgtcgaaacagggtctcaccgtgttgcccaggctggtctcaaactcctagtctcaagccttggcctctcaaagtgctaggattacaggggtgaaccaccatggtaggccagaagaccacatgttatttgattcccatttggggagtgattgctaatggctatggggtttctttcaggggctctaaaattgattgagatggttgcacaattctgtgaatagagtcaaaaccattgatttgtgccctttaaatgagttaactgtatggtacatctcaaagctgtta

SEQ ID NO: 13271 - DNA, 412 bp, Homo sapiens
gtgtgatatattggcagtttgggaaattttatcccaagtcataaaaacccatttatataatattaggatagttgcttttaaaaggaatattttgtaactgatattcaacacatgaaattgtgagttctggctaggcgtggtgactcatgcttgtaatcccagcactttgggaggccaaggtgggctgatcacttgagtccagaagttcaagaccagcctgggcaacatggtgaaaccccacttctaccgaaaatacaaaaatttgccaggcatgatggcacctgcctatagtcccagctcctttcagggggctgaggcaggaggattgttcaagcccagaagttgaggctacggtgagccaagattgcaccattacagtccagcttaggtgacaaagtgagaccctgtctcc

SEQ ID NO: 13272 - DNA, 381 bp, Homo sapiens
gtcggcacccatgtccaatgatgggagatggttaagcaaattatgataaattcacagaatgaaactgtgtataaccattaaaaattatacttaccaaggctgggcgtggtgactcatgcttgtaatcccagcactttgggaggccaaggtgggctgatcacttgagtccagaagttcaagaccagcctgggcaacatggtgaaaccccacttctaccgaaaatacaaaaatttgccaggcatgatggcacctgcctatagtcccagctcctttcagggggctgaggcaggaggattgttcaagcccagaagttgaggctacggtgagccaagattgcaccattacagtccagcttaggtgacaaagtgagaccctgtctcc

SEQ ID NO: 13273 - DNA, 182 bp, Homo sapiens
ttttgtagagacagggtttcaccatgtttgtcaggcttgaactcctgacctcaagtgatccacccacctcagcctcccaaagtgctgggattacaggcgtgagccaccacacccggccacattatttttttctatattcatcctgatacgctatcaaatagtgggtcttattcattctttct

SEQ ID NO: 13274 - DNA, 407 bp, Homo sapiens
agaccacggctgaggccaggagcagtagcaggtgggaactcaagactggttgcactgtaactcctgagagtcagggttcttctgtttagctaagaaaatttgggggtgtttggtagaacagtgaatccttttccaggggctggtaaatgcaatgaaatgaatactacagagataacatgcatatcaaacacatacttttgtccaatgcacagcccaactctcattctagccacactgccctgcctttaaaaagttaaaaagaaaaataagataaaaagtgcaccatgggccaggtgcagtggcccacgcctgtaatcccaacactttgagaggctgaggtggaggatcactggagcccaggagtttgagaccagcttgggcaacacagtgagacctctctactactt

SEQ ID NO: 13275 - DNA, 254 bp, Homo sapiens
ctcactgatgctttttaaaaatcactttttaagattttttttttctttttgtactttagctagtgtctgttcttgtatcttcaagtttgctaatcttttcttctgcagtttctaatctgctttagttcatccaatgtaattttcatctcaaatgtttttgtctttgaaagtttgattttggcttttcttgtttatctcccatgtctctatttaactttttgattatatgggatacatgtataaaaacagttgaa

SEQ ID NO: 13276 - DNA, 160 bp, Homo sapiens
tggaaacaaaaaagagaccaaatagccaaagcagtcctgagcaaaaagaacaaagctggaggcatcatactacctgacttcaatatatattacaaggctatactgagcacaacagcatgatatttgtataaatcagacacatagaccaatggaacagaat

SEQ ID NO: 13277 - DNA, 350 bp, Homo sapiens
agatactaatacttgggttggaaatagacccaataggtcatcttgtccatcctcctgcctcaggcaggactaatgatatatgtttgtcttattcttcccctagaactccaggggtcaaaatactgtatattcctccactcatccatccatccatccatccgtcatttattgaaacatgagtaggacagtggacctctcctttaacaactcatggtatagtcttttcagagtttccaatccctaaccagcaagagtaatttctaatgtctaaactaaatgtctaatctaatccagtgtctaatttctaacatctaatctaatgtcttcatttcgtaaataaagagaaggat

SEQ ID NO: 13278 - DNA, 432 bp, Homo sapiens
ctgcaagttcaattttataaaaaacggtattaaacttttgaaacatgattgggtttaatttttagtgttctcatcctttttgcactcttcaccacttaattattcacatttcttgactcagtttgtttatcataagactcttaattcctgaagggcaatcattaaattcatcacaagtcattccttgataattccttttattttggctgcttattggtaagatgcttcagcaataccaaacgtcagcttaataatgcagatactcaggacctgcgtttcttggaggaagcttcatggttatcctaccccttgctgaaccagtgttttaaaagctacagtaagtaaagcagacaaacgcatagtttttctaattttgtttaaatatctaatcatcttttaataaagcattcagttgcttcacctgtgtttcac
